(12) United States Patent
Colston, Jr. et al.

(10) Patent No.: US 9,434,997 B2
(45) Date of Patent: Sep. 6, 2016

(54) METHODS, COMPOUNDS AND SYSTEMS FOR DETECTING A MICROORGANISM IN A SAMPLE

(75) Inventors: Bill W. Colston, Jr., San Ramon, CA (US); J. Patrick Fitch, Middletown, MD (US); Shea N. Gardner, Oakland, CA (US); Peter L. Williams, San Anselmo, CA (US); Mark C. Wagner, Livermore, CA (US)

(73) Assignee: Lawrence Livermore National Security, LLC, Livermore, CA (US)

( * ) Notice: Subject to any disclaimer, the term of this patent is extended or adjusted under 35 U.S.C. 154(b) by 1322 days.

(21) Appl. No.: 12/196,238

(22) Filed: Aug. 21, 2008

(65) Prior Publication Data

US 2009/0081675 A1 Mar. 26, 2009

Related U.S. Application Data

(60) Provisional application No. 60/966,047, filed on Aug. 24, 2007.

(51) Int. Cl.
*C12Q 1/68* (2006.01)
*C12Q 1/70* (2006.01)

(52) U.S. Cl.
CPC .............. *C12Q 1/689* (2013.01); *C12Q 1/701* (2013.01)

(58) Field of Classification Search
None
See application file for complete search history.

(56) References Cited

FOREIGN PATENT DOCUMENTS

WO         02/099130         12/2002

OTHER PUBLICATIONS

Gardner et al. (J. of Clin. Micro, 2003, 41(6):2417-2427).*
Sen (J. Clin. Micro, 2000, 38(5):1953-1958).*
Ho et al. (J Clin Micro, 1991, 29(11):2543-2549).*
Colson et al. (BMC Microbiology, 2006, 6:21, 1-8).*
Johnson etal. (Infect. Immun,2000,68(3):1587-1599).*
Irina Afonina et al., "Primers with 5' flaps improve real-time PCR", BioTechniques, vol. 43, No. 6, 2007, pp. 770-774.
Stephen F. Altschul et al., "Gapped BLAST and PSI BLAST: a new generation of protein database search programs", Nucleic Acids Research, 1997, vol. 25, No. 17 3389-3402.
Jannine Brownie et al., "The elimination of primer-dimer accumulation in PCR", Nucleic Acids Research, 1997, vol. 25, No. 16, pp. 3235-3241.
Anna Casabianca et al, "Fast and sensitive quantitative detection of HIV DNA in whole blood leucocytes by SYBR green I real-time PCR assay", Molecular and Cellular Probes 21 (2007) 368-378.
Ramu Chenna et al., "Multiple sequence alignment with the Clustal series of programs", Nucleic Acids Research, 2003, vol. 31, No. 13,pp. 3497-3500.

Todd Z. DeSantis et al., "High-Density Universal 16S rRNA Microarray Analysis Reveals Broader Diversity than Typical Clone Library When Sampling the Environment", Microbial Ecology vol. 53, 371-383 (2007).
David J. Ecker et al., "The Ibis TSOOO Universal Biosensor: An Automated Platform for Pathogen Identification and Strain Typing", JALA Dec. 2006 11:341-351.
Sean R. Eddy, "Profile hidden Markov models", Bioinformatics, vol. 14 No. 9 1998, pp. 755-763.
Robert C. Edgar, "MUSCLE: multiple sequence alignment with high accuracy and high throughput", Nucleic Acids Research, 2004 vol. 32 No. 5, 1792-1797.
Robert A. Edwards et al., "Viral metagenomics", Nature Reviews Microbiology, 3:504-510, 2005.
S. Escutenaire et al., "SYBR Green real-time reverse transcription-polymerase chain reaction assay for the generic detection of coronaviruses", Archives of Virology, (2007) 152: 41-58.
Michael D. Gadberry et al., "Primaclade-a flexible tool to find conserved PCR primers across multiple species", Bioinformatics, vol. 21 No. 7, 2005, pp. 1263-1264.
Shea N. Gardner et al., "Limitations of TaqMan PCR for Detecting Divergent Viral Pathogens Illustrated by Hepatitis A, B, C, and E Viruses and Human Immunodeficiency Virus", Journal of Clinical Microbiology, Jun. 2003, p. 2417-2427, vol. 41, No. 6.
Yu-Cheng Huang et al., "Integrated minimum-set primers and unique probe design algorithms for differential detection on symptom-related pathogens", Bioinformatics, vol. 21 No. 24, 2005, pp. 4330-4337.
Omar J. Jabado et al., "Greene SCPrimer: a rapid comprehensive tool for designing degenerate primers from multiple sequence alignments", Nucleic Acids Research, 2006, vol. 34, No. 22 6605-6611.
Simon N. Jarman, "Amplicon: software for designing PCR primers on aligned DNA sequences" Bioinformatics, vol. 20 No. 10, 2004, pp. 1644-1645.
Amy Kistler et al., "Pan-Viral Screening of Respiratory Tract Infections in Adults With and Without Asthma Reveals Unexpected Human Coronavirus and Human Rhinovirus Diversity", JID 2007:196 (Sep. 15).
Daryl Lamson et al., "MassTag Polymerase-Chain-Reaction Detection of Respiratory Pathogens, Including a New Rhinovirus Genotype, That Caused Influenza-Like Illness in New York State during 2004-2005", pp. 1398-1402 JID 2006:194 (Nov. 15).
Baochuan Lin et al., Broad-spectrum respiratory tract pathogen identification using resequencing DNA Inicroarrays, Genome Research, 16:527-535, 2006.

(Continued)

*Primary Examiner* — Stephanie K Mummert
(74) *Attorney, Agent, or Firm* — Steinfl & Bruno, LLP

(57) ABSTRACT

Methods to identify a set of probe polynucleotides suitable for detecting a set of targets and in particular methods for identification of primers suitable for detection of target microorganisms related polynucleotides, set of polynucleotides and compositions, and related methods and systems for detection and/or identification of microorganisms in a sample.

10 Claims, 19 Drawing Sheets

(56) References Cited

OTHER PUBLICATIONS

Baochuan Lin et al, "Using a Resequencing Microarray as a Multiple Respiratory Pathogen Detection Assay", Journal of Clinical Microbiology, Feb. 2007, p. 443-452, vol. 45, No. 2.

Chaim Linhart et al., "The degenerate primer design problem", Bioinformatics, vol. 18 Suppl. 1, 2002, pp. 5172-5180.

J.S. Mackenzie et al., Emerging Viral Diseases of Southeast Asia and the Western Pacific, Emerging Infectious Diseases, vol. 7, No. 3 Supplement, Jun. 2001.

Marcel Margulies et al., "Genome sequencing in microfabricated high-density picolitre reactors", Nature, vol. 437,:376-380, 2005.

Nicholas R. Markham et al., "DINAMelt web server for nucleic acid melting prediction", Nucleic Acids Research, 2005. vol. 33, Web Server issue W577-W581.

Santosh Nanda et al., "Universal virus detection by degenerate-oligonucleotide primed polymerase chain reaction of purified viral nucleic acids", Journal of Virological Methods 152 (2008) 18-24.

Gustavo Palacios et al., "Panmicrobial Oligonucleotide Array for Diagnosis of Infectious Diseases", Emerging Infectious Diseases, vol. 13, No. 1, pp. 73-81, Jan. 2007.

Jean-Philippe Pichon et al., "Quantitative multiplex degenerate PCR for human endogenous retrovirus expression profiling", Nature Protocols, vol. I No. 6, 2006, pp. 2831-2838.

Adrian E. H. Png et al., "Primer design for whole genome amplification using genetic algorithms", In Silico Biology 6, (2006) pp. 1-10.

Phenix-Lan Quan et al, "Detection of Respiratory Viruses and Subtype Identification of Influenza A Viruses by GreeneChipResp Oligonucleotide Microarray", Journal of Clinical Microbiology, Aug. 2007, p. 2359-2364, vol. 45, No. 8.

John Rachlin et al., "MuPlex: multi-objective multiplex PCR assay design", W544-W547 Nucleic Acids Research, 2005. vol. 33, Web Server issue.

Rangarajan Sampath et al., "Rapid Identification of Emerging Infectious Agents Using PCR and Electrospray Ionization Mass Spectrometry", Ann. N. Y. Acad. Sci. 1102: 109-120 (2007). Abstract.

Timothy M. Rose et al., "CODEHOP (COnsensus-DEgenerate Hybrid Oligonucleotide Primer) PCR primer design," Nucleic Acids Research, 2003, vol. 31, No. 13 3763-3766.

Anthony P. Shuber et al., "A Simplified Procedure for Developing Multiplex PCRs", Genome Research 5:488-493, 1995.

Xin-Wei Wang et al., "Development and application of an oligonucleotide microarray for the detection of food-borne bacterial pathogens", Appl Microbiol Biotechnol (2007) 76:225-233.

David Wang et al., "Microarray-based detection and genotyping of viral pathogens", PNAS , Nov. 26, 2002, vol. 99, No. 24, pp. 15687-15692.

David Wang et al., "Viral Discovery and Sequence Recovery Using DNA Microarrays", PLoS Biology, 2003, vol. 1, Issue 2, p. 257-260.

Mark E. J. Woolhouse, "Where Do Emerging Pathogens Come from?", Nov. 2006 Microbe 1:511-515.

Tania M. Wetzel et al., "Real-Time PCR Assay for Detection and Quantification of Hepatitis B Virus Genotypes A to G", Journal of Clinical Microbiology, Sep. 2006, p. 3325-3333, vol. 44, No. 9.

\* cited by examiner

Amplicon sequence virus_num 0:

virus name: >gi|37223495|gb|AY390432.1| Foot-and-mouth disease virus Asia1 strain YNBS/58, complete genome amplicon_len: 103  FP: TTCAGGCATAGAAGCTT (revcomp of AAGCTTCTATGCCTGAA)  RP: AGGATGCCCTTCAGGTA  Start: 931  End: 1033
AGGATGCCCTTCAGGTACCCCGAGGTAACATCTGACACTCGGATCTGAGGGGACTGGGACTTCTTTAAAAGTGCCCGGTTTAA
AAAGCTTCTATGCCTGAA
amplicon_len: 149  FP: CGCAGGTAAAGTGATCT (revcomp of AGATCACTTTACCTGCG)  RP: CTCTCCTTTGCACGCCG  Start: 7870  End: 8018
CTCTCCTTTGCACGCCGTGGGACCATACAGGAGAAGTTGATCTCCGTGGCAGGACTCGCCGTCCACTCTCGACCTGACGAGTAC
CGGCGTCTCTTCGAGCCCTTCCAGGGCCTCTTTGAGATTCCAAGCTACAGATCACTTTACCTGCG
amplicon_len: 361  FP: CACGTACTTTCTCCATCG (revcomp of CGATGGAGAAAGTACGTG)  RP: GTCATCTTCTCCAAACAC  Start: 6799  End: 7159
GTCATCTTCTCCAAACACAAAGGGGACACAAAGATGACCGAGGAGGACAAAGCGCTGTTCCGCCGCTGCGCTGCTGACTACGCG
TCACGATTGCACAGGGTACTCGGTACGGCAAATGCCCCACTGAGCATCTACGAGGCAATCAAAGGCGTCGACGGTCTTGACGCC
ATGGAGCCAGATACTGCGCCTGGTCTCCCCTGGGCCC
TCCAGGGGAAGCGCCGCGGCGCACTGATTGACTTCGAGAACGGCACGGTCGGACCCGAGGTCGCGGCTGCCCTAGAGCTCATG
GAGAAAGAGAAATACAAATTTGTTTGTCAGACCTTCCTGAAGGACGAGATTCGCCCGATGGAGAAAGTACGTG
...and so on for each sequence

Amplicon distribution
mean number bands: 2
min number bands: 1
max number bands: 3 amp string: 103_149_361  (i.e. bands of length 103, 149, and 361 are predicted)
ID: >gi|37223495|gb|AY390432.1| Foot-and-mouth disease virus Asia1 strain YNBS/58, complete genome amp string: 104_149
ID: >gb|AY593755.1|gi|48610766|Foot-and-mouth disease virus A isolate a15thailand iso43, complete genome ID: >gb|AY593830.1|gi|48610916|Foot-and-mouth disease virus C isolate c7poland iso49, complete genome amp string: 104_149_361
ID: >emb|AJ320488.1|gi|18074006|Foot-and-mouth disease virus O genomic RNA, isolate O1Campos, complete genome ID: >gb|AY593837.1|gi|48610930|Foot-and-mouth disease virus O isolate ouruguay-51 iso54, complete genome
...and so on for each fragment banding pattern

METHODS, COMPOUNDS AND SYSTEMS FOR DETECTING A MICROORGANISM IN A SAMPLE

CROSS REFERENCE TO RELATED APPLICATIONS

This application claims priority to U.S. Provisional Application entitled "Method for Developing Unique Genetic Signatures for Viral Characterization" Ser. No. 60/966,047, filed on Aug. 24, 2007, the disclosure of which is incorporated herein by reference in its entirety.

STATEMENT OF GOVERNMENT GRANT

The United States Government has rights in this invention pursuant to Contract No. DE-AC52-07NA27344 between the U.S. Department of Energy and Lawrence Livermore National Security, LLC, for the operation of Lawrence Livermore National Security.

TECHNICAL FIELD

The present disclosure relates to detection and/or identification of polynucleotides sequences and of targets associated thereto, especially microorganisms, and in particular of viruses and bacteria.

BACKGROUND

High sensitivity detection of microorganisms and in particular of viruses has been a challenge in the field of biological molecule analysis, in particular when aimed at detection of a plurality of microorganisms. Whether for pathological examination or for fundamental biology studies, several methods are commonly used for the detection of various classes of microorganisms.

In particular, researchers employ numerous approaches for viral detection and discovery, including metagenomic sequencing [ref. 5], microarrays [ref. 9, 10, 12, 13, 18, 21, 24 and 25], or multiplex degenerate PCR followed by other methods of characterization such as mass spectrometry [ref. 4, 11, 22] or amplicon sequencing [ref. 8].

PCR is a rapid and cost effective technique suitable for the purpose. In some applications, however, PCR relies on specific primer sets, and it does not scale well for detection of many diverse targets, and in particular of many diverse microorganisms.

In case of viruses, high levels of diversity and lack of any universally conserved nucleotide or amino acid sequence regions makes it a challenge to detect well-characterized viruses and extremely difficult to discover novel viruses by methods that involve sequence-specific amplification. In contrast, bacteria contain universally conserved 16s rRNA sequences from which conserved primers may be designed, allowing amplification of rRNA coding regions from novel, unsequenced bacteria. [ref. 3, 26] Bacterial rRNA sequences vary sufficiently for discrimination to the family, genus, and sometimes even the species level.

As a consequence, primer design for detection and/or identification of known or unknown microorganisms, especially viruses, can be challenging. Nevertheless, PCR-based techniques for viral amplification and identification are common at the species or strain level. [ref. 6, 7, 19, 27]. These rely on careful primer design from the most conserved regions available, taking advantage of degenerate primers and/or replacement of variable positions with inosine bases, and the design and multiplex optimization of minimal sets of signatures which must be used in combination to ensure detection of all known variants.

However, multiplex primer design for many highly divergent targets is challenging, since usually no universally conserved primers exist to amplify fragments from all targets, and finding sets of primers likely to function well in multiplex, adds to the complexity of finding conserved primer candidates.

Furthermore, currently available multiplex/degenerate primer prediction tools require multiple sequence alignment [ref. 34, 36-38, 41]. Multiple sequence alignments are often difficult to construct for many sequences, exhausting either memory or available time, or both, before an alignment is completed. Moreover, even if an alignment does complete, for some divergent target sets such as RNA virus genomes of a single species or gene homologues across species, in some cases, alignments may be of suboptimal quality, or there is so little nucleotide sequence conservation that multiple primers, possibly with degenerate positions, are required to amplify all targets.

In particular, for many organisms there are few or no conserved regions of sufficient size across all strains of a species for a pair of traditional-length primers (at least 18 bases), particularly in important single-stranded RNA viruses including influenza A, HIV1, ebola, and foot and mouth disease viruses. PCR-based specific (non-random) amplification across all viral families using typical 18+ base primers would require many thousands of PCR primers to span known viral sequence diversity.

Additionally, with PCR-based specific amplification approaches, which require specific primers for each species or strain, discovery or detection of unanticipated species is usually unlikely.

SUMMARY

Provided herein, are probe polynucleotides, and in particular primers, that are suitable for detecting a plurality of microorganisms and/or identifying unknown microorganisms and related compositions, methods and systems.

In particular, according to a first aspect, a method to identify a set of probe polynucleotides, in particular primers, suitable for detecting a set of targets, in particular, target microorganisms is disclosed. The method comprises: identifying the set of target microorganisms; and identifying a set of rules to be satisfied by target sequences. The method further comprises: identifying a set of target polynucleotides by selecting one or more target polynucleotides, so that each target polynucleotide is comprised in at least one microorganism of the target microorganisms, and each target polynucleotide comprises a target sequence satisfying to the set of rules. The method also comprises: identifying the set of probe polynucleotides by reverse complementing one or more of the target sequences of the target polynucleotides of the identified set of target polynucleotides.

According to a second aspect, a method for identification of primers suitable for detection of targets and in particular target microorganisms is disclosed. The method comprises the steps of: i) identifying a first set of candidate oligonucleotides present in at least one of the target microorganisms; ii) sorting the candidate oligonucleotides of the first set by number of target microorganisms in which they occur, and iii) identifying second and third sets of candidate oligonucleotides, said second and third sets comprising oligonucleotides lying within a distance range of the oligonucleotides of the first set of candidate oligonucleotides, the second set comprising oligonucleotides lying upstream of the first set, and the third set comprising oligonucleotides lying downstream of the first set. The method also comprises: iv) sorting the candidate oligonucleotides of the second and third sets by number of target microorganisms in which they occur; and v) selecting a most frequently occurring oligonucleotide from the first set as one primer and a most frequently occurring oligonucleotide from the second and third sets as another primer. The method still further comprises: vi) if the other primer is selected from the second set, including a reverse complement of the one primer and the other primer in a set of selected primers; otherwise, if the other primer is selected from the third set, including the one primer and a reverse complement of the other primer in the set of selected primers. The method also comprises: vii) updating a list of target microorganisms to be detected by eliminating from the list target microorganisms having valid amplicons generated by any combination of primers in the set of selected primers; and viii) repeating steps ii) through vii) until a detectable amplicon has been generated by all target microorganisms to be detected.

According to a third aspect, a method for identification of primers suitable for detection of targets and, in particular, target microorganisms is disclosed. The method comprises the steps of: i) identifying a first set of candidate oligonucleotides present in at least one of the target microorganisms; ii) sorting the candidate oligonucleotides of the first set by number of target microorganisms in which they occur; and iii) selecting a most frequently occurring oligonucleotide as one primer. The method further comprises: iii) for all target microorganisms containing the one primer, identifying a second set of candidate oligonucleotides within an upstream or downstream distance range of the one primer; iv) sorting the candidate oligonucleotides of the second set by number of target microorganisms in which they occur; and v) selecting a most frequently occurring oligonucleotide from the sorted candidate oligonucleotides of the second set as another primer. The method also comprises: vi) if the other primer is downstream of the one primer, including the one primer and a reverse complement of the other primer in a set of selected primers; otherwise, if the other primer is upstream of the one primer, including a reverse complement of the one primer and the other primer in the set of selected primers. The method still further comprises: vii) updating a list of target microorganisms to be detected by eliminating from the list target microorganisms having valid amplicons generated by any combination of primers in the set of selected primers; and viii) repeating steps ii) through vii) until a detectable amplicon has been generated by all target microorganisms to be detected.

According to a fourth aspect, a method for identification of primers suitable for detection of target microorganisms. The method comprises the steps of: i) identifying a set of candidate oligonucleotides present in at least one of the target microorganisms; ii) sorting pairs of the candidate oligonucleotides of the set by number of target microorganisms in which they occur within a predetermined distance from each other; iii) selecting the most frequently occurring pair as a pair of primers; and iv) including the pair of primers in a set of selected primer pairs. The method also comprises: v) updating a list of target microorganisms to be detected by eliminating from the list target microorganisms having valid amplicons generated by any pair in the set of selected primer pairs; and vi) repeating steps ii) through v) until a detectable amplicon has been generated by all target microorganisms to be detected.

According to a fifth aspect, set of probe polynucleotides, and in particular a set of primers, is disclosed. The polynucleotides are identifiable by the methods herein disclosed.

According to a sixth aspect, a composition comprising a set of probe polynucleotides, and more particularly a set of primers, of the present disclosure is disclosed, wherein the polynucleotides are comprised in the composition together with and a suitable carrier, vehicle and/or auxiliary agent.

According to a seventh aspect, a method to detect a set of target microorganisms in a sample is disclosed. The method comprises: identifying the set of target microorganisms, each target microorganism of the set of target microorganisms comprising a target polynucleotide; and identifying a set of probe polynucleotides, in particular primers, suitable for identification of the set of target microorganisms with one of the methods herein disclosed. The method further comprises: contacting the identified set of probe polynucleotides with the sample for a time and under condition to allow formation of a probe polynucleotide-target-polynucleotide complex, thus providing a set of probe-polynucleotide-target-polynucleotide complexes; detecting the set of probe polynucleotide target polynucleotide complexes; and comparing the set of detected probe-polynucleotide-target-polynucleotide complexes with a predetermined set of probe-polynucleotide-target polynucleotide complexes, each predetermined probe-polynucleotide-target polynucleotide complex of the predetermined set of probe-polynucleotide-target polynucleotide complexes associated with a target microorganism of the set of target microorganisms.

According to an eighth aspect, a method to identify an unknown microorganism to be included in a set of microorganisms is disclosed. The method comprises: identifying the set of target microorganisms, each target microorganism of the set of target microorganisms comprising a target polynucleotide; and identifying a set of probe polynucleotides, in particular primers, suitable for the identification of the set of target microorganisms with one of the methods herein disclosed. The method further comprises: contacting the identified set of probe polynucleotides with the sample for a time and under condition to allow formation of probe-polynucleotide-target polynucleotide complex, thus providing a set of probe-polynucleotide-target polynucleotide complexes; and detecting the set of a probe-polynucleotide-target-polynucleotide complexes. The method also comprises comparing the set of detected a probe-polynucleotide-target polynucleotide complexes with a set of predetermined probe-polynucleotide-target polynucleotide complexes, each predetermined probe-polynucleotide-target polynucleotide complex of the predetermined set of probe-polynucleotide-target polynucleotide complexes associated with a target microorganism of the set of target microorganisms; and identifying a detected probe-polynucleotide-target polynucleotide complex that cannot be associated with any predetermined probe-polynucleotide-target polynucleotide complex of the set of probe-polynucleotide-target polynucleotide complexes, the identified detected probe-polynucleotide-target polynucleotide complex associated with the unknown microorganism.

According to a ninth aspect, a system for detecting a set of targets and in particular target microorganisms, in a sample and/or for identifying unknown microorganisms to be included in a set of microorganisms is disclosed. The system comprises: a set of probe polynucleotide, in particular primers herein disclosed; and a reagent for providing and/or detecting a complex of said probe polynucleotides with target polynucleotides of said targets.

The probe polynucleotides, compositions, methods and systems herein disclosed allow multiplex detection of a set of microorganisms comprising highly divergent target microorganisms. In particular, the primers, compositions, methods and systems herein disclosed, can be used to detect a set of microorganism including some divergent target microorganisms such as RNA virus genomes of a single species or gene homologues across species, as well as target microorganisms with little nucleotide sequence conservation.

The probe polynucleotides, compositions, methods and systems herein disclosed further allow detection of a set of microorganisms comprising a large and possibly diverse group of microorganisms, using a near-minimal multiplex-compatible set of primers capable of amplifying target sequences in any microorganism of the set of microorganisms at issue (universal primers). In particular, methods and systems herein disclosed allow predicting primer sets for all available complete genomes or segments for every viral family, as well as separate primer sets for several highly diverse species of RNA viruses.

The probe polynucleotides, compositions, methods and systems herein disclosed allow a strategy of detection by PCR amplification with universal primers followed by limited sequencing, fragment length measurement, base composition, or other amplicon-characterizing method, of just a few amplicons per organism which can be used for a fast, cheap, and advantageous for high throughput viral surveillance and discovery.

The probe polynucleotides, compositions, methods and systems herein disclosed, allow use of primers selected to satisfy requirements imposed by the experimental design of choice, such as avoidance of primer-dimers or homodimers formation, isothermal $T_m$'s to improve efficiency of multiplex detection, and allowable GC % range.

The probe polynucleotides, compositions, methods and systems herein disclosed allow detection of a set of microorganisms including a high number of diverse microorganisms with approaches that do not require multiple sequence alignment to be performed.

The probe polynucleotides, compositions, methods and systems herein disclosed can be used in biowarfare detection applications, in particular for identifying, detecting, and monitoring bio-threat agents that contain nucleic acid signatures, such as spores, bacteria, viruses etc.

The probe polynucleotides, compositions, methods and systems herein disclosed can also be used in biomedical applications, in particular for (a) tracking, identifying, and monitoring outbreaks of infectious disease including emerging, previously unidentified and genetically engineered pathogens; and/or (b) automated processing, amplification, and detection of host or microbial and viral DNA or RNA in biological fluids for medical purposes.

The probe polynucleotides, compositions, methods and systems herein disclosed can further be used in forensic applications, in particular for automated processing, amplification, and detection of DNA in biological fluids for forensic purposes.

The probe polynucleotides, compositions, methods and systems herein disclosed can also be used for verification of food and beverage safety and in particular for (a) automated food testing for bacterial or viral contamination; and/or (b) high throughput genetic screening for drug discovery and novel therapeutics The details of one or more embodiments of the disclosure are set forth in the accompanying drawings and the description below. Other features, objects, and advantages will be apparent from the description and drawings, and from the claims.

BRIEF DESCRIPTION OF THE DRAWINGS

The accompanying drawings, which are incorporated into and constitute a part of this specification, illustrate one or more embodiments of the present disclosure and, together with the detailed description, serve to explain the principles and implementations of the disclosure.

FIG. 8 shows an example of output files from find_amplicons.pl, which compares a list of multiplexed primers to a file of sequences.

FIG. 17 shows a block diagram illustrating the fraction blast hits in target and non-target families for amplicons generated using specific amplification with the universal 10-mer primers for a selection of newly emerged viruses.

FIG. 18 shows a block diagram illustrating the average number blast hits in target and non-target families for amplicons generated using specific amplification with the universal 10-mer primers for a selection of newly emerged viruses.

Figure 1:
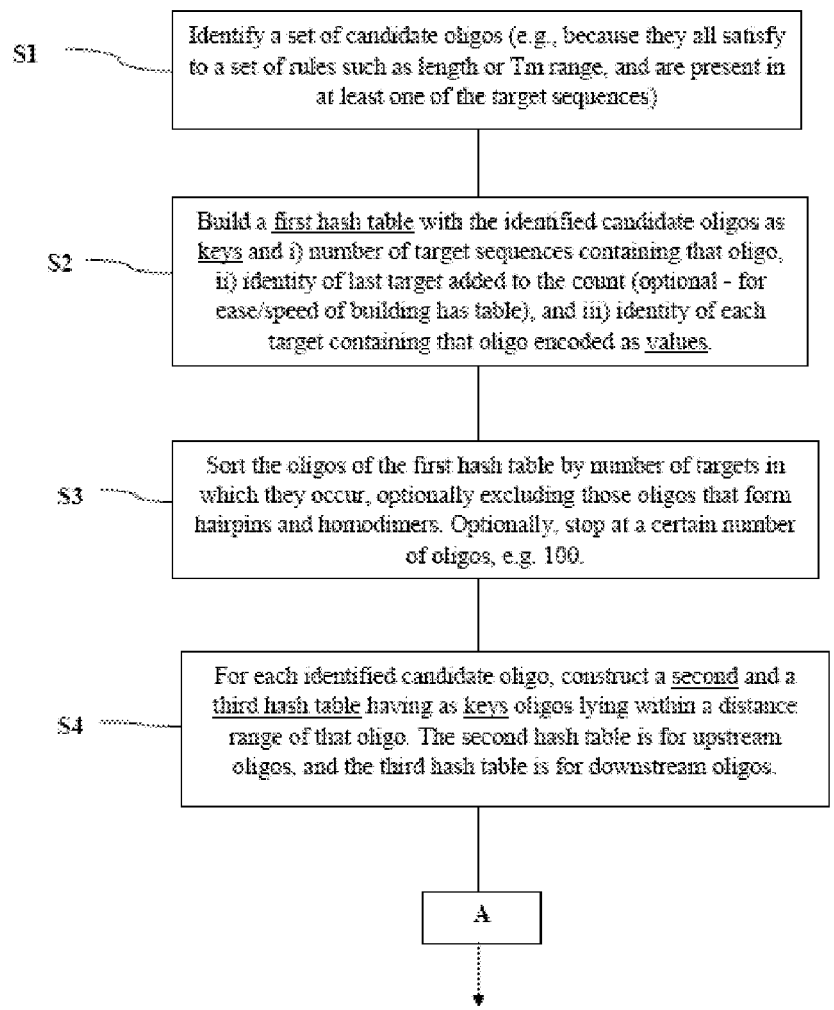
FIGS. 1 to 3 show a first exemplary algorithm to identify probe polynucleotides according to an embodiment herein disclosed.

The present specification also contains appendices A to E, each of which makes part of the present specification and is incorporated by reference in its entirety.

DETAILED DESCRIPTION

Primers, compositions, methods and systems are herein disclosed that can be used for detection and/or identification of targets, and in particular microorganisms, in a sample.

The term "probe" as used herein indicates a hybridization probe, i.e. a polynucleotide of variable length, which is used to detect another polynucleotide (herein also target polynucleotide) having a nucleotide sequence that is complementary to the sequence in the probe. The probe thereby hybridizes to single-stranded nucleic acid (DNA or RNA) whose base sequence allows probe-target base pairing due to complementarity between the probe and target. Exemplary probe polynucleotides are primers suitable for amplification of target polynucleotides.

The term "polynucleotide" or "nucleic acid" as used herein indicates an organic polymer composed of two or more monomers including nucleotides, nucleosides or analogs thereof. The term "nucleotide" refers to any of several compounds that consist of a ribose or deoxyribose sugar joined to a purine or pyrimidine base and to a phosphate group and that is the basic structural units of nucleic acids. The term "nucleoside" refers to a compound (as guanosine or adenosine) that consists of a purine or pyrimidine base combined with deoxyribose or ribose and is found especially in nucleic acids. The term "nucleotide analog" or "nucleoside analog" refers respectively to a nucleotide or nucleoside in which one or more individual atoms have been replaced with a different atom or a different functional group. Accordingly, the term "polynucleotide" includes nucleic acids of any length and DNA or RNA analogs and fragments thereof. A short polynucleotide, typically with 60 or fewer nucleotides is also called a nucleotidic oligomer or oligonucleotide, although there is no strict length criteria for defining an oligonucleotide, and strands up to 200 nucleotides can be called oligonucleotides. Probe polynucleotides may be synthesized via phosphoramidite technology or generated and labeled by PCR amplification or cloning (older methods). In order to increase the in vivo stability of the probe RNA is not used, instead RNA analogues may be used, in particular morpholino.

The term "primer" as used herein indicates a strand of nucleic acid that serves as a starting point for replication of a polynucleotide (herein also template polynucleotide). In particular, a primer is able to hybridize a template strand of the template polynucleotide and allow a polymerase to form on the template strand, an elongating strand that is complementary to said template strand. In several applications, primers are usually 6-36 nucleotides long, most often in the range of 18-30 nucleotides, although it is conceivable to have shorter or longer primers. A primer may be introduced in a reaction mixture as a single strand polynucleotide or a double strand polynucleotide and/or as a precursor polynucleotide that can be then converted into the primer by enzymatic reactions or other reactions identifiable by a skilled person upon reading of the present disclosure.

The term "hybridization" as used herein refers to the process of combining complementary, single-stranded nucleic acids into a single molecule, and in particular an at least partially double stranded polynucleotide wherein bases of each strand are bound to bases of the other strand through hydrogen bonding.

The term "detect" or "detection" as used herein indicates the determination of the existence, presence or fact of a target or signal in a limited portion of space, including but not limited to a sample, a reaction mixture, a molecular complex and a substrate. A detection is "quantitative" when it refers, relates to, or involves the measurement of quantity or amount of the target or signal (also referred as quantitation), which includes but is not limited to any analysis designed to determine the amounts or proportions of the target or signal. A detection is "qualitative" when it refers, relates to, or involves identification of a quality or kind of the target or signal in terms of relative abundance to another target or signal, which is not quantified.

The term "identification" as used herein indicates the process of assigning a new or pre-existing individual name or class name to an individual target or a group of targets, such as compounds or microorganisms. Identification of compounds or microorganisms with individual names (or codes) is usually based on individualistic features uniquely associated with the compound or microorganism. In particular, identification of groups of targets (and in particular of set of targets) is usually based on one or more features uniquely associated with the targets of that group of targets.

The term "target" as used herein indicates an analyte of interest. The term "analyte" refers to a substance, compound or component whose presence or absence in a sample has to be detected. Analytes include but are not limited to microorganisms, polynucleotides and related sequences.

The term "microorganism" as used herein refers to an organism of microscopic or ultramicroscopic size such as a prokaryotic or a eukaryotic microbial species or a virus. The term "prokaryotic" refers to a microbial species which contains no nucleus or other organelles in the cell, which includes but is not limited to Bacteria and Archaea. The term "eukaryotic" refers to a microbial species that contains a nucleus and other cell organelles in the cell, which includes but is not limited to Eukarya such as yeast and filamentous fungi, protozoa, algae, or higher Protista.

The term "bacteria" as used herein refers to prokaryotic microbial species which include but are not limited to Gram-positive and Gram-negative bacteria, *Proteobacteria, Cyanobacteria, Spirochetes* and related species, *Planctomyces, Bacteroides, Flavobacteria, Chlamydia*, Green sulfur bacteria, Green non-sulfur bacteria including anaerobic phototrophs, Radioresistant micrococci and related species, *Thermotoga* and *Thermosipho thermophiles*.

The term "virus" refers to a sub-microscopic infectious agent that is unable to grow or reproduce outside a host cell. Each viral particle, or virion, consists of genetic material, (polynucleotides such as DNA or RNA), within a protective protein coat called a capsid. The capsid shape varies from simple helical and icosahedral (polyhedral or near-spherical) forms, to more complex structures with tails or an envelope. Viruses infect all cellular life forms and are grouped into animal, plant and bacterial types, according to the type of host infected. Examples of viruses associated with human diseases include but are not limited to influenza, Ebola, AIDS, avian influenza and SARS.

The term "sample" as used herein indicates a limited quantity of something that is indicative of a larger quantity of that something, including but not limited to fluids from a biological environment, specimen, cultures, tissues, commercial recombinant proteins, synthetic compounds or portions thereof.

In several embodiments, the methods comprise identifying a set of microorganisms to be detected. The wording "set of" as used herein with reference to microorganisms, primers, polynucleotides or other analytes indicate a group including one or more of said analytes. Accordingly, identification of the set of microorganisms to be detected can be performed by assigning a new or pre-existing name to a group of microorganisms that share one or more features uniquely associated with the microorganisms of the group of microorganisms that forms the set to be detected.

In several embodiments, the methods herein disclosed comprise identifying a set of rules to be satisfied by target sequences. The rules of the set of rules can in particular be directed to control base pairing between probe polynucleotide and target polynucleotide and the specificity of related hybridization reactions. The wording "specific" "specifically" or "specificity" as used herein with reference to the binding of a molecule to another, such as polynucleotide hybridization, refers to the recognition, contact and formation of a stable complex between the molecule and the another, together with substantially less to no recognition, contact and formation of a stable complex between each of the molecule and the another with other molecules. The term "specific" as used herein with reference to a molecular component of a complex (e.g. a nucleic acid strand of a double stranded polynucleotide), refers to the unique association of that component to the specific complex which the component is part of. In some embodiments, the set of rules is identified to maximize the specificity of the hybridization between probe nucleotides and target polynucleotides.

The target polynucleotides can then be selected by selecting one or more polynucleotides that is comprised in at least one microorganism of the identified set of target microorganisms, and that comprises a target sequence satisfying to the set of rules.

In some embodiments, probe polynucleotides, and in particular primers, that are suitable for detecting and/or identifying any microorganisms of a set of target microorganisms (herein also universal primer) are identified by reverse complementing the one or more target polynucleotides of the identified set of target polynucleotides.

The wording "reverse complement" as used herein indicates the negative sense, minus strand or complement of a double stranded polynucleotide, that (a) can hybridize to the positive sense, or plus strand of the same double stranded polynucleotide, and (b) is provided in the 5' to the 3' direction. The word "complement" indicates that the sequence is such that where there is an A in the plus strand, there is a T in the complement, and where there is a C in the plus strand, there is a G in the complement, and vice versa. The word "reverse" indicates that the minus or complement strand is given in the 5' to 3' direction, so that its sequence is the reverse of the complement to the plus strand.

In some embodiments, an experimental design of choice is selected in view of the set of rules to be satisfied by target sequences to further control the specificity of polynucleotide hybridization. In particular, in some of those embodiments, the experimental design is selected to maximize the specificity of said hybridization.

In some embodiments, the probe polynucleotides are primers and the set of target polynucleotides comprises two or more target polynucleotides.

In some embodiments, identifying a set of target polynucleotides can be performed by identifying a first target polynucleotide and a second target polynucleotide in at least one microorganism of the set of target microorganisms. In particular, the second target comprises a target sequence that satisfies to a rule requiring that the detection of the microorganism is performed by the combined use of the second target polynucleotide and the first target polynucleotide (e.g. as primers in a PCR or other amplification reactions). In some of those embodiments the set of probe polynucleotides is formed by primers and includes a pair of primers identified by complementing target sequences of the first target polynucleotide or the second target polynucleotide.

In some of those embodiments, at least one of the first and the second target polynucleotides can be further identified in one or more additional target microorganisms different from the initial target microorganism. One or more additional target polynucleotides that comprise one or more additional target sequences can then be identified in the additional target microorganisms. In particular the additional target sequences of the additional target polynucleotide satisfy to a rule that requires that the detection of the additional target microorganisms is performed by the combined use of the additional target polynucleotides and at least one of the first target polynucleotide and the second target polynucleotide. In some of those embodiments, the set of primers includes a first pair of primers identified by complementing target sequences of the first target polynucleotide or the second target polynucleotide and a second pair of primers identified by complementing target sequences of at least one of the first target polynucleotide and the second target polynucleotide and target sequences of the one or more additional target polynucleotides.

In other embodiments at least a first additional target polynucleotide and a second additional target polynucleotide can be further identified in at least a second additional target microorganism of the set of target microorganisms.

The first and second additional target polynucleotide are selected to satisfy a rule requiring that detection of the second additional target microorganism is performed by the second additional target polynucleotide in combination with the at least first additional target polynucleotide. In some of those embodiments, the set of primers includes a first pair of primers identified by complementing target sequences of the first target polynucleotide or the second target polynucleotide and an at least second additional pair of primers identified by complementing target sequences of the first additional target polynucleotide and the second additional target polynucleotide In some embodiments, the identification of suitable primers to detect and/or identify target microorganisms can be performed according to the following steps.

In a first step, a set of acceptable primer candidates is identified. In some embodiments, the first step is performed by reverse complementing a set of target polynucleotides that a) are common to microorganisms of the set of microorganisms to be detected and that b) satisfy the rules of the identified set of rules, as illustrated in the exemplary procedure of Example 6, later discussed.

In particular, in some embodiments, as illustrated in the exemplary procedure of Example 1, later discussed, once certain rules/specifications of experimental design of choice (e.g. desired length, Tm, lack of homopolymer strings etc) are predetermined (e.g. to allow an effective multiplexed detection), a set of polynucleotides that satisfy the predetermined specifications (or parameters) and are common to all or part of the microorganisms of the set of microorganisms to be detected, can be selected. In some embodiments, identification of conserved primers that are also target specific can also be performed, for example with the procedure exemplified in Example 2, later discussed.

In other embodiments, illustrated in the exemplary procedure of Example 3, later discussed, common polynucleotides that occur in all or part of the microorganisms of interests are first identified, the specifications of choice can then be set and the common oligonucleotide matching the desired specification selected.

In all of those embodiments, the target polynucleotides to be used in the identification of the primers herein described are usually identified on the basis of the set of target microorganisms to be detected/identified as illustrated in the exemplary procedures of Examples 4 and 7, later discussed.

In a second step, a set of primer pair is defined on the basis of the acceptable primer candidates identified by the first step. In particular, the set of primer pairs is selected to include primer pairs that allow amplification of target polynucleotides in any microorganisms of the set of microorganisms, as illustrated in the exemplary procedure of Example 6, later discussed.

In some embodiments, the selection of the primer pair is performed by selecting a first primer pair that amplifies at least one target polynucleotide selected according to the first step. Further primer pairs can then be identified by selecting primer pairs that amplify target polynucleotides which are not amplified by other primer pairs until target polynucleotides from all microorganisms of the set of microorganisms to be detected can be amplified. In particular, the primers of each pair can be identified by identifying a first candidate primer and a second candidate primer located upstream or downstream the first candidate primer in target polynucleotides of two or more of the microorganisms to be detected at a distance that allow amplification according to the amplification technique of choice. In some embodiments, all primers of the selected primer pairs are also compared against all targets to be detected by allowing any combination of primers so that primer pairs can be optimized to minimize the number of primers necessary to obtain at least one detectable amplicon from every one of the targets.

The terms "amplify" and "amplification", as used herein with reference to target polynucleotides, indicate a procedure for isolating and exponentially amplifying (e.g. through replication of) a fragment or sequence of a polynucleotide. Exemplary procedures that can be used to amplify a polynucleotide and in particular a target polynucleotide include but are not limited to Polymerase Chain Reaction (PCR), Rolling circle amplification (RCA), Ramification extension amplifying method (RAM), Helicase-dependent amplification (HAD), Abscription (Abortive Transcription), Cycling Probe Technology, Ligase Chain Reaction, Linked Linear Amplification, Looped-Mediated Isothermal Amplification (LAMP), Single Primer Isothermal Amplification (SPIA), Split Promoter Amplification Reaction (SPAR), Strand Displacement Amplification (SDA), and Multiplex Ligation Probe Assay (MLPA).

The term "amplicon" as used herein indicates pieces of a polynucleotide formed as the products of an amplification event. For example, amplicons can be formed via polymerase chain reactions (PCR), ligase chain reactions (LCR) and other procedures for amplifying a polynucleotide identifiable by the skilled persons upon reading of the present disclosure.

Exemplary procedures to perform the identification of primer pairs are illustrated in FIGS. 1 to 3, FIGS. 4 to 6 and FIG. 7 and further exemplified in Examples 1, 3 and 6. Degenerate bases may be included in primer sequences, allowing sequence variation in the target sequences recognized, or hybridized, by the primer. These procedures can be implemented by software and executed by a processor on a computer.

In some embodiments, the method to identify primers herein described can be used for identifying primers particularly suitable to perform multiplexed detection of target microorganisms. In those embodiments the method is also indicated as Multiplex Primer Prediction (MPP) method or software algorithm. The MPP can be used to build multiplex compatible primer sets for large, diverse sets of target sequences.

In some embodiments, the primer identification method herein disclosed, and in particular the MPP, can be used to identify primers suitable to detect and/or identify microorganisms (such as viruses) with high levels of intraspecies sequence variation, which often slip past PCR-based detection if the sequences of some isolates do not contain a match to the specific primers used.

In some embodiments, the MPP can be used to design multiplex primer sets for amplifying homologues in a gene family. In those embodiments, input sequences to MPP could be provided by gene sequences and optionally a small region up- and down-stream of the gene to consider for primer selection, rather than whole genomes as Applicants have demonstrated in the procedures illustrated in the Examples section. A user can specify an appropriate amplicon length range to ensure amplification of an adequate span across the gene.

In some embodiments, the primer identification method and in particular the MPP could also be used to design multiplex primer sets for unrelated target sequences, for example, multiple bacterial and viral species or gene families, in a single reaction. Since no sequence alignment is required, there is no need for any sequence conservation among targets. Combined with a downstream method to identify the amplicons produced, such as hybridization, fragment lengths, or sequencing, MPP is the only available tool to do de novo design of multiplex compatible primer sets to amplify unrelated target sequences in a single PCR.

In various embodiments, the primer identification method and in particular MPP allows design of a large number of diverse primers in a highly scalable (see in particular Example 11, later described), automated fashion (see Example 5, later described) that does not require multiple sequence alignment (see Example 5). In particular, the MPP can be used to design universal primer sets to amplify all available genomes from predetermined sets of microorganisms such as viral families, as well as to generate primer sets for several diverse species such as foot-and-mouth disease virus, influenza, Norwalk virus, and HIV-1. More particularly, in some embodiments, an MPP algorithm is based on conserved k-mer subsequences, requiring no multiple sequence alignments, where multiplex-compatible primer sets are built up de novo as illustrated in the procedures described in the Examples section. In some embodiments, the code may be run from a web interface after uploading an input fasta file of target sequences and selecting parameter values like primer length and $T_m$ and amplicon length ranges, or the source code may be downloaded and run locally.

In some embodiments, exemplified by the procedure illustrated in Example 5 over 25 thousand Orthomyxoviridae sequences were used as input in one run, as well as all Poxviridae sequences, many of them ~200 Kb long. In other embodiments, exemplified by the procedure illustrated in Example 6, later described, runs can be performed using all available viral genomes from all families simultaneously as the input. For many target sets, such as those including all the genomes of a species, predicting a universal primer set usually requires only minutes. With extremely large, highly diverse target sequence sets such as all Orthomyxoviridae sequences, a primer prediction run may take days. Memory requirements can be reduced for example by representing oligonucleotide sequences as bit vectors, with each nucleotide coded as a bit instead of a byte, by using suffix arrays to track all candidate oligonucleotides and their frequencies in the targets, and/or by ranking the primer candidates by frequency. For the top ranked primer candidates, the code can use again suffix arrays or suffix trees to determine oligonucleotide locations in each target sequence. The code can also allow degenerate primers or primers with a limited (user specified) number of mismatches to targets (e.g. using hamming or edit distance options for suffix array calculations).

The sets of probe polynucleotide, and in particular primers, identifiable with the identification method herein described include but are not limited to universal primer sets for all viruses, for each viral family, as well as for several species and serotypes, including influenza, HIV-1, foot-and-mouth disease, and Norwalk viruses and other viruses such as the ones indicated in Example 5, later described, and universal primers for gene families, or other target sets for which sequence data is available.

The number of primers in a universal set depends on the $T_m$ and primer length requirements, as well as the number and diversity of target sequences. In particular, in some embodiments, MPP, in contrast to some prior art techniques, generates non-degenerate primer sets predicted to work in multiplex, to avoid primer dimers, and it does not require any sequence alignment or labor-intensive manual steps to downselect from among multiple candidates or design primers to detect outlying targets.

In some embodiments, sets of primers for detecting and/or identifying viral family include almost 2000 10-mer primers, or ~3700 18-mer primers, as shown in the exemplary procedure of Example 6, later described. Relaxing melting temperature constraints, allowing isothermal primer length variation, or including all primers in a single, highly multiplexed reaction rather than as a series of smaller multiplexes reduces the number of primers required for universal amplification by 20-80%, although these changes would impose greater empirical demands for successful multiplexing.

In some embodiments, universal primer sets consisting of about 7 to about 30 base pair nucleic acid strands can be used to amplify sequences of target viral DNA/RNA as illustrated in the procedure exemplified in Examples 5 and 6. These primer sets can be designed to amplify specific nucleic acid sequences of all viral complete genomes sequenced to date, as well primer sets designed separately for various subgroupings of the viruses, including for each of the viral families (currently 70 virus families with available full genome or full segment sequence data). In embodiments wherein the primer size is fixed at 10 bases (10-mer), between 2 and <700 primers are required in family-level universal sets. The number of primers in a family's set increases with the number of available genomes for that family, as well as the diversity of the family. Sequences for representative sets of these primers are given in Appendix A incorporated herein by reference in its entirety. Examples of primer sets have been provided for each viral family, generated with parameters as indicated in Example 5.

Accordingly, in some embodiments the set of probe polynucleotides can include the sets illustrated in Appendix A (which makes part of the presented specification and is incorporated herein by reference in its entirety), a combination thereof or variants thereof. More particularly, set of primers herein disclosed can comprise a polynucleotide having a sequence selected from the group consisting of SEQ ID NO: 1 to SEQ ID NO:11,333 or a degenerate sequence thereof, wherein the term "degenerate" is used to identify sequences that have at least one degenerate position, i.e. a position which has an ambiguity of one or more bases, with respect to the original sequence while maintaining the ability to hybridize (under the same or other reaction conditions) the same target sequences of the original sequence. More particularly, set of primers can be used for detection of viral families and/or specific viruses as indicated in the Examples and in Appendix A, wherein various combinations of polynucleotides from the same or different sets indicated in the Examples or in Appendix for a certain microorganism or group of microorganism are included in the scope of the present disclosure.

Other primer sets are possible, and can be generated using the code provided in Appendix E, modifying the parameters as desired by the user.

In some embodiments, a probe polynucleotide set identified with the primer identification method herein described can be included in a composition together with a suitable carrier, vehicle or auxiliary agent.

The polynucleotides identified with the identification methods herein described and or the related compositions can be used in a method to detect microorganism of a set of microorganisms in a sample wherein the identified set of polynucleotides is contacted with the sample for a time and under conditions to allow formation of a probe polynucleotide-target polynucleotide complex which can be formed by amplicons in case of amplification of target polynucleotides of the set of target microorganisms with primers. The set of probe-target complexes (and in particular of target amplicons) thus provided can be detected and compared with a predetermined set of probe polynucleotide-target polynucleotide complexes, associated with a target microorganism of the set of target microorganisms.

In some embodiments, the probe polynucleotide identified with the identification methods herein disclosed can be used to identify new and previously unknown microorganism. In those embodiments, the unknown microorganism is identified by identifying at least one probe polynucleotide-target polynucleotide complex that cannot be associated with any predetermined probe-polynucleotide-target polynucleotide complexes of the predetermined set of probe polynucleotide-target polynucleotide complexes. In particular, in those embodiments the identified probe polynucleotide-target polynucleotide complex is associated with the unknown microorganism.

In some of those embodiments, the probe polynucleotides are primers. In particular, previously unknown microorganisms of the set of microorganisms are identified using a primer with a length of less than 11 bases (see simulation procedure exemplified in Example 10, later described).

More particularly, some embodiments are based on the observation that short primers are more likely to be conserved among both known, sequenced microorganisms and unknown or unsequenced microorganisms. Amplicons generated using short primers that do not match amplicons predicted based on known, sequenced microorganisms, indicate that an unknown organism is present (see Example 10). The novel amplicons can be further characterized, such as by amplicon sequencing and comparison to existing sequence databases. Amplicons can also be exploited to further characterize the unknown, for example by designing primers based on the novel amplicon, and using them to amplify or sequence additional regions from the sample containing the novel organism.

In some embodiments, the method to detect/identify a set of microorganisms is performed by contacting the set of identified probe polynucleotides (and in particular primer pairs) with the sample in a single reaction vessel, (see Example 5, specifically the examples indicated as "no Bins"). In particular, all probes (and in particular primers) for a given target set of sequences are intended to be mixed in a single multiplex reaction for creating an amplicon from any one of those target sequences (see Example 5). The probes going into the multiplex reaction can be computationally selected to avoid probe dimers.

In other embodiments, the method to detect/identify a set of microorganisms is performed by subdividing an initial sample in several (even millions or billions) of discrete sub-samples to allow analysis of every individual microorganism in the set in parallel as illustrated in the exemplary procedure of Example 14 wherein the probes are primers. In particular, in view of reaction kinetics and thermodynamics created by multiplexing an enormous number of primers in order to simultaneously amplify a huge number of different targets, in some embodiments, the sample can be divided into bins based on the set of microorganisms of interest (e.g. a viral family of interest), or alternatively based on the multiplex compatibility of the primers involved (the approach used in the procedure of Example 6.

In those embodiments, each subsample would only contain a smaller set of probes, limiting the complexity of the hybridization and detection reactions. In some of those embodiments the hybridization is also performed using small primers (e.g. of length 5-11 nucleotides), which are likely to hybridize any target (including unknowns), versus using larger oligos with more specificity. Use of smaller probes, and in particular smaller primers, requires a more limited multiplex compared to other embodiments, since shorter probes are more likely to be conserved among more target sequences, meaning that in the exemplary case in which probes are primer, fewer primers in total should be required to generate amplicons from every target. However, short primers may also reduce the amplicon resolution since for some microorganisms the primers in a set may amplify dozens to thousands of amplicons, making it difficult to differentiate or further characterize each fragment when it is part of a more complex mixture of sequences (see Examples 8, 13 and 14).

In some embodiments, hybridization and detection (e.g. through amplification and sequencing) of a few, randomly chosen fragments can be performed. In particular, Applicants performed simulations to determine how the length and number such fragments affect the ability to classify that virus as to its correct family, and found that sequencing a few 100-mer fragments is likely to provide correct family identification, and is likely to provide more information than sequencing a single fragment that is ten times longer (see Examples 9, 10, and 12). A possible explanation that is not intended to be limiting of the scope of the disclosure is that in some of those embodiments the 100-mer regions could be more dispersed across the genome of the target than a single, longer region, and this may increase the probability of including a region that is characteristic of the appropriate family. However, in some of those embodiments a sophisticated empirical strategy might need to be employed to separate out one or a few amplicons for sequencing per genome, since one would not have a specific sequencing primer if fragments are selected randomly. One could imagine that pyrosequencing [ref 15] methods might be adaptable to such a strategy, with modification so as to rapidly amplify only a few, randomly selected fragments from each of many samples rather than more deeply sequencing a single sample. Cost and speed might be the advantages of sequencing a limited number of fragments rather than more deeply sequencing many oligonucleotide fragments from a sample, so long as a sufficient number are sequences so as to characterize the organism(s) in the sample to the desired level.

In other embodiments, a specific amplification (directed to amplify specific predetermined fragments, as opposed to random amplification directed to amply randomly chosen fragments) can be performed e.g. by using short primers of 5-11 nucleotides. In those embodiments, in view of the short length of the primers, it is essential to purify the sample, excluding as much contaminating nucleic acids from eukaryotic and prokaryotic sources as possible, since simulations indicate that sets of short multiplex primers will generate hundreds or thousands of amplicons from a human or typical bacterial genome, overwhelming any viral signal. Alternatively, longer primers can be used, including but not limited to lengths of 17-30 nucleotides, and these can be designed so as to have more specificity to the targets, which should allow less thorough sample purification to eliminate eukaryotic DNA/RNA prior to amplification.

In the methods to detect/identify microorganisms herein disclosed the detected complexes are compared to predetermined complexes associated to microorganisms of the set of microorganisms to identify the microorganism associated to the detected complex. In particular, in embodiments wherein the probes are formed by primers, following amplification of the target polynucleotides, the related amplicons can be detected and then compared with predetermined amplicons associated with known microorganisms to detect the microorganism associated with the amplicon or identify a previously unknown microorganism.

Detection of the probe polynucleotide-target polynucleotide complexes can be performed with techniques identifiable by a skilled person, which can vary in view of the specific probe polynucleotide used in the probe polynucleotide-target polynucleotide complexes. In particular, detection of a probe polynucleotide-target polynucleotide complex can be performed through labels or labeled molecules.

The terms "label" and "labeled" as used herein refers to a probe, primer or other molecule that is capable of being detected. Labels include but are not limited to radioactive isotopes, fluorophores, chemiluminescent dyes, chromophores, enzymes, enzymes substrates, enzyme cofactors, enzyme inhibitors, dyes, metal ions, nanoparticles, metal sols, ligands (such as biotin, avidin, streptavidin or haptens) and the like. The term "fluorophore" refers to a substance or a portion thereof which is capable of exhibiting fluorescence in a detectable image. As a consequence the wording and "labeling signal" as used herein indicates the signal emitted from the label that allows detection of the label, including but not limited to radioactivity, fluorescence, chemoluminescence, production of a compound in outcome of an enzymatic reaction and the likes.

For example, in some embodiment, detection of a probe polynucleotide-target polynucleotide complex can be performed by labeled probes that can be detected with methods known or identifiable by a skilled person such as Southern blotting RNAase protection or the likes. For example, to detect hybridization of the probe to its target sequence, the probe can be tagged (or labelled) with a molecular marker; commonly used markers are $^{32}P$ (a radioactive isotope of phosphorus incorporated into the phosphodiester bond in the probe DNA) or Digoxigenin, which is non-radioactive antibody-based marker. DNA sequences or RNA transcripts that have moderate to high sequence similarity to the probe are then detected by visualizing the hybridized probe via autoradiography or other imaging techniques. Detection of sequences with moderate or high similarity depends on how stringent the hybridization conditions were applied—high stringency, such as high hybridization temperature and low salt in hybridization buffers, permits only hybridization between nucleic acid sequences that are highly similar and therefore detection of specific complexes, whereas low stringency, such as lower temperature and high salt, allows hybridization when the sequences that are less similar. Hybridization probes used in DNA microarrays refer to DNA covalently attached to an inert surface, such as coated glass slides or gene chips, and to which a mobile cDNA target is hybridized. When the probe polynucleotide is a primer, detection can be performed by detecting products of replication of a target polynucleotide and in particular amplicons.

In other embodiments, wherein the probes are primers, the detection of the amplicon is performed by detecting the lengths of the resulting amplicon fragments determined through a technique such as separation using gradient electrophoresis. In those embodiments, the microorganisms detection is based on the unique electrophoretic banding signature created by the amplification of individual fragments from a given species or strain of virus. Examples of some fragment length distributions detectable using gradient electrophoresis are given in Appendices B-D each of which makes part of the present specification. Additional procedures suitable to detect amplicons and/or perform viral characterization include but are not limited to techniques such as mass spectrometry to estimate base composition (like that used by IBIS T5000) [ref. 4, 22], electrophoretic determination of fragment size distributions, fragment sequence, microarray or other (e.g. Luminex beads, nano bar codes, etc.) hybridization patterns.

An exemplary procedure suitable to detect amplicons for various sets of microorganisms (and in particular viruses) is illustrated in Example 14, later discussed.

Systems for detection and/or identification of target microorganisms are also disclosed. The systems include a set of probes, and in particular primers, herein disclosed alone or in combination with reagents suitable to perform the detection according to the methods herein disclosed.

The systems herein disclosed can be provided in the form of kits of parts. In particular in a kit of parts, one or more primers (in particular, a set of primers) and possibly also other reagents can be comprised in the kit independently possibly included in a composition together with suitable vehicle carrier or auxiliary agents. For example a polynucleotide can be included in one or more compositions alone and/or included in a suitable vector. Also, the primers of the set of primers can be included in a composition alone or together with other primers of the same set. Furthermore, the primers can be included in various forms or compositions that are suitable for use in amplifying target polynucleotides of interest or to detect the polynucleotide of interest with other techniques that do not require amplification of the target. For example, in some embodiments, a labeled primer can be included in the kit to allow detection using techniques identifiable by the skilled person and that vary in view of the label used.

In some embodiments, a labeling molecule can also be included in the kit herein disclosed, that allows detection of the amplicons or the polynucleotide of interest and include but are not limited to labeled polynucleotides, labeled antibodies, other labels identifiable by the skilled person upon reading of the present disclosure.

Additional components can also be included and comprise system reference standards, and additional components identifiable by a skilled person upon reading of the present disclosure.

In the kit of parts herein disclosed, the components of the kit can be provided, with suitable instructions and other necessary reagents, in order to perform the methods here disclosed. In some embodiments, the kit can contain the compositions in separate containers. Instructions, for example written or audio instructions, on paper or electronic support such as tapes or CD-ROMs, for carrying out the assay, can also be included in the kit. The kit can also contain, depending on the particular method used, other packaged reagents and materials (i.e. wash buffers and the like).

Further details concerning the identification of the suitable carrier agent or auxiliary agent of the compositions, and generally manufacturing and packaging of the kit, can be identified by the person skilled in the art upon reading of the present disclosure.

EXAMPLES

The methods and system herein disclosed are further illustrated in the following examples, which are provided by way of illustration and are not intended to be limiting.

Example 1

Algorithm for Calculating Highly Conserved, Multiplexed Primer Sets

To select highly conserved universal primers for a set of targets, Applicants have coded the following algorithm in PERL, provided as Appendix E. The universal set of primers should produce at least one amplicon in each of the target sequences. The process is as follows:

1) First, one identifies all candidate oligos occurring in the target set of sequences that fall in the desired length and $T_m$ ranges (Table 1), do not contain homopolymer strings longer than 4 bases, do not contain non-ATCG bases, and are not composed entirely of dinucleotide repeats. $T_m$'s and free energies (see below) are calculated using Unafold. [ref. 39] Alternative values of any of the parameters in Table 1 may be desired, and can be specified by the user. Alternatively, candidate oligos can be selected based on GC % and length, rather than $T_m$. Alternative methods of calculating $T_m$ and free energies may be used. All parameter settings are provided as examples, and are not exclusive.

TABLE 1

| Parameter | Value |
| --- | --- |
| Minimum $T_m$ | 35° C. * (10-mer) or 55° C. (17-18-mer) |
| Maximum $T_m$ | 50° C. (10-mer) or 70° C. (17-18-mer) |
| $x_{homodimer}$ | −7 kcal/mol |
| $x_{dimer}$ | −7 kcal/mol |
| $x_{hair}$ | −5 kcal/mol |
| $d_1$ | 80 |
| $d_2$ | 620 |

* Throughout, $T_m$ and ΔG are calculated using Unafold with $[Na^+] = 0.2$ M, $[Mg^{+2}] = 0.0015$ M, $T_{anneal} = 30°$ C., strand concentration of each strand of 1e−07 M, and with the "DNA" option. Alternative settings may be employed, as specified by the user.

These candidate oligos are stored in a hash $h_1$ with the oligo sequences as keys (stored as strings, or in another embodiment, stored as bit vectors) and values containing bit vectors composed of the following: the number of genomes containing that oligo, the identity of the last target sequence added to the count (to speed the initial hash construction), and the identities of each target sequence containing that oligo. Target sequences are referenced by number in a lookup table. This representation stores the oligo frequencies efficiently for subsequent calculations, but does not track the location of each oligo in each sequence, to reduce memory requirements. Currently, oligo sequences in the keys are represented as character strings (8 bits/character), although in a future version this will be replaced with storage of A, C, T, and G using only 2 bits each, providing a four-fold memory savings.

2) Second, the oligos are sorted by the frequency of target sequences in which they occur. A set $s_1$ of the 100 most frequent oligos whose homodimer and hairpin free energies exceed $x_{homodimer}$ and $x_{hair}$, respectively, is constructed. Since free energy calculation is relatively time consuming, these are only calculated as needed until the set $s_1$ has been populated with 100 oligos (this number is a tunable parameter that can be set by the user).

3) Next, two more hashes are constructed like the first for each oligo i in $s_1$, using only the subsequences from the original targets that lie within distance range $d_1$-$d_2$ of that oligo $s_{1i}$. One is a hash $h_{2u}$ for the upstream oligos, and the other is a hash $h_{2d}$ for the downstream oligos. After sorting both $h_{2u}$ and $h_{2d}$ by frequency in the target sequences, the oligo j is chosen for each oligo i that occurs most frequently either upstream or downstream, giving the most frequent oligo pairs (i,j). Again, only oligos j with homodimer and hairpin free energies exceeding $x_{homodimer}$ and $x_{hair}$ and (i,j) dimer free energy exceeding $x_{dimer}$ are allowed, so if the most frequent j is not energetically acceptable, the next most frequent j is selected until an acceptable oligo can be found. The most frequent pair (i*,j*) is selected from among all (i,j) pairs. If j* is from $h_{2u}$, then it becomes primer $p_1$ and the reverse complement of i* becomes primer $p_2$, while if j* is from $h_{2d}$ then the reverse complement of j* and i* are used as primers. These primers are added to the reaction bin.

4) Then the list of target sequences yet to be detected is updated, eliminating any with valid amplicons in the specified size range generated by any combination of primers already selected. The values of hash $h_1$ are also updated by subtracting from the oligo frequency counts those targets detected and removing their target identities.

5) The process from steps 2-4 is repeated for the targets not yet detected until all targets have a valid amplicon, adding the constraint at the end of step 3 that primers $p_1$ and $p_2$ must have dimer free energies exceeding $x_{dimer}$ with any primer already selected, in order to be added to the bin. If either primer in the pair is predicted to dimerize with any primer already selected in that bin, then the next most frequent pair (i*,j*) is checked for acceptability as primers, until a suitable pair is found. In step 4, since primers in a bin are intended to be mixed in multiplex, targets can be detected by any combination of primers in any orientation relative to one another, not just those that were selected as a pair. Applicants call these unintended detections "serendipitous hits", and update the list of yet-to-be-detected targets and $h_1$ accordingly.

6) If the option to bin primers in subsets of b primers is selected, primers are added to a bin until that bin contains a maximum of b primers, at which point a new bin is begun. Occasionally, the same primer may be selected more than once in the same bin, paired with a different oligo, resulting in an odd number of primers. Binning primers in small groups avoids exclusion of the most highly conserved oligos because of primer dimer free energy constraints. It also results in fewer amplicons on average per genome, since each reaction bin contains fewer primers than would a larger multiplex of unbinned primers.

In the software release, Applicants also include a script, find_amplicons.pl, to predict all the amplicons that should be generated by a list of (multiplexed) primers mixed with any fasta file of sequences (FIG. 8). For each sequence, all amplicon sequences (for example, SEQ ID NO: 11353, SEQ ID NO: 11354 and SEQ ID NO: 11355 as shown in FIG. 8), their length and position, and the forward primer (for example, SEQ ID NO: 427, SEQ ID NO: 425 and SEQ ID NO: 429 as shown in FIG. 8)+reverse primer (for example, SEQ ID NO: 428, SEQ ID NO: 426 and SEQ ID NO: 430 as shown in FIG. 8) combination to yield that product (or if appropriate an indication that no amplicons are predicted) as well as the reverse complimentary sequences of the forward primers (for example, SEQ ID NO: 11356, SEQ ID NO: 11357 and SEQ ID NO: 11358 as shown in FIG. 8) are printed to an output file. The amplicon sequences facilitate downstream analysis, such as probe design or fragment length or sequence comparisons among the amplified sequences. The script also produces a summary file of the fragment length distributions, or expected banding patterns, and a list of the sequence headers predicted to display each pattern.

Figure 2:
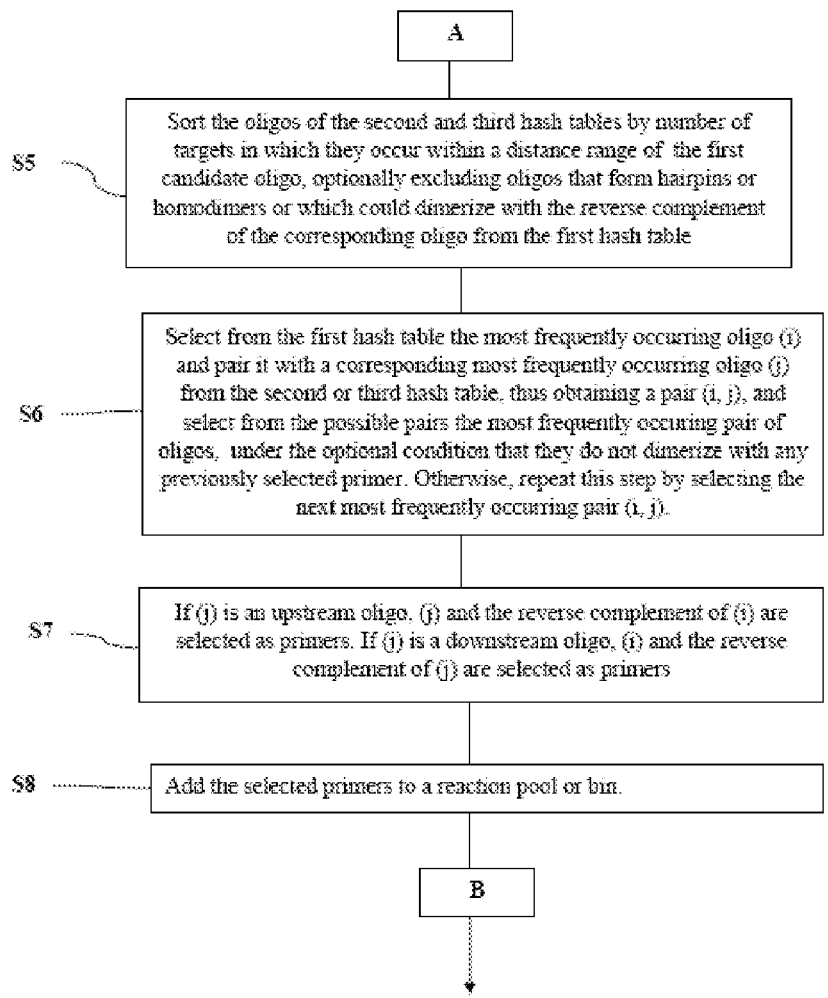
Figure 3:
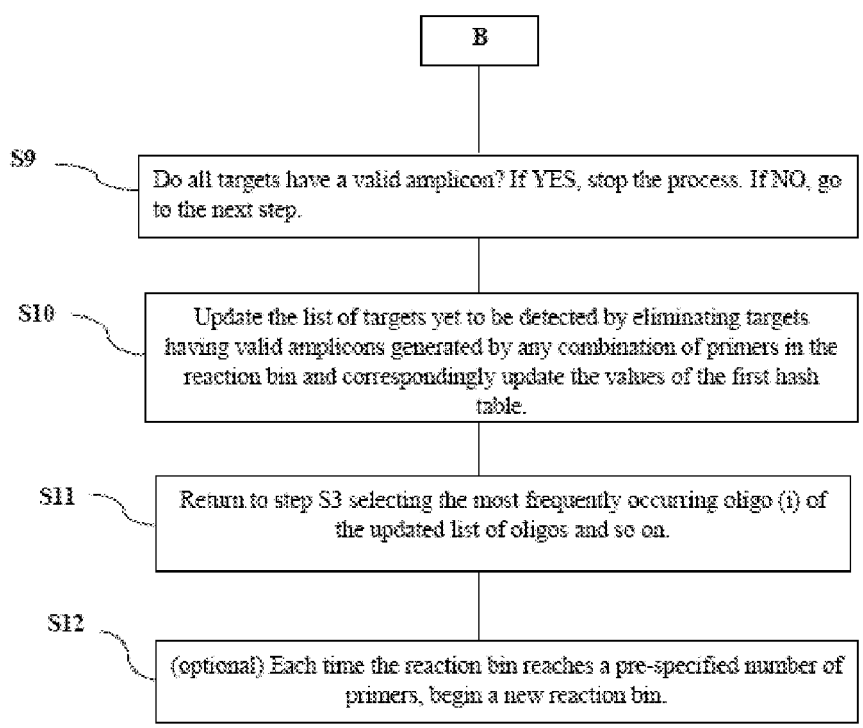

An embodiment of the present disclosure on which Example 1 is based is shown in the flowchart of FIGS. 1 to 3, which show steps S1-S12 for performing a method to identify primers suitable for detecting target microorganisms.

Example 2

Identification of Conserved and Target Specific Primers

The code described in Example 1 focuses on finding conserved primers, and does not require that the primers be family- or species-specific. Thus, organisms outside the target sequence set could also generate amplicons. To ensure that a member of the target group is present using the primers generated using the methods described above requires analysis of the amplicons produced (for example, sequence, base composition, or length). However, if specific as well as conserved primers are required, the simplest approach would be to input a set of target sequences in which all k-mers (where k is the primer length) present in any non-target organism have been replaced by "N"'s.

These non-unique oligos will not be considered as primer candidates, and can be found using, for example, BLAST [ref. 29] or suffix array software such as vmatch (http://www.vmatch.de/). This approach, however, does risk being overly strict by eliminating some potentially successful candidate primers: it takes two primers in proximity to generate an amplicon, so 1) a single non-unique primer, 2) a pair of primers too far apart to actually generate an amplicon in a non-target sequence, or 3) nearby candidate oligos that partially overlap a non-unique stretch of N's might actually work to uniquely amplify members of the target set. Applicants are currently formulating a modified algorithm to address the third of these issues, which after hashing candidate oligonucleotides as described in Example 1 step 1, those oligonucleotides are checked against a nucleotide sequence database of non-target sequences using suffix array software such as vmatch, and candidate oligonucleotides that are not unique to the target sequences (with a user-selected level of 0 or more mismatches or indels by hamming or edit distance) are eliminated from further consideration as candidate primers by eliminating them from the hash h1. In the current version of the MPP of Example 1, all primers sets described in the analyses performed here are conserved, but they were not checked for uniqueness.

Example 3

Algorithm for Calculating Highly Conserved, Multiplexed Primer Sets Meeting Required Specification Primer sets were identified according to the following process.

1) List all acceptable primer candidates: First, all oligos that occur in any of the sequences in the target set are found, where the target set is a set of viral genomes, either all viral genomes or the genomes in a particular family. Only those matching the desired specifications proceed. These specifications can be any or all of the following: length, Tm, and GC % within specified ranges, no homopolymer strings of more than 4 bases (e.g. primers with AAAAA (SEQ ID 11,334) not allowed), and no primers that are composed entirely of a dinucleotide repeat. Applicants have developed code that predicts conserved universal primers that may vary in length but that have isothermal melting temperatures to improve their compatibility in multiplex reactions. Tm's are predicted using our streamlined version of the most accurate software currently available: Unafold®, based on nearest neighbor thermodynamics. As part of a Tech Based Award through the Computations directorate, Applicants improved the speed of Unafold so that it can predict the Tm's of over 100 million oligonucleotides in just hours, making it feasible for predictions for even the largest viral families. In addition, Applicants have implemented a new addition to the algorithm to further aid the prediction of multiplexed primer sets by avoiding primer dimers, homodimers, and hairpins, which compete with the desired reactions of primer-target binding. These undesired reactions can also be predicted using the thermodynamic models in the Unafold software, although these computations are slower, so they are performed later as described below. The location of each primer in each of the target genomes is recorded, even if a given oligo occurs multiple times. Forward versus reverse complements of oligos are also tracked, since it will be important whether a primer will amplify in the forward or reverse direction. The strand that is given as the plus strand in Genbank is arbitrary for double-stranded genomes. To make this memory-intensive process feasible, data is stored as bits rather than bytes, in an efficient hash lookup table. This lookup table contains sequence and positional information of each candidate primer in each of the target genomes. Applicants also have an option in the code to tie the hash to disk, if memory is still limiting. Although that requires longer run times, it does allow larger numbers or longer sets of target genomes to be analyzed, although running the analyses subdivided by viral family does not require tying the hash file to disk.

2) Select the first primer pair: Oligos are sorted by the frequency of presence/absence in the target genomes, and the primer candidate p1 present in the most genomes is selected. The hairpin and homodimer free energy is calculated, and if the oligo passes the user's specifications, then that oligo continues for consideration as p1. If not, it is excluded from further consideration and the next most conserved oligo is selected as p1. Then, for all genomes that contain p1, all oligos within an allowable distance range d upstream (5') of the highest frequency oligo are again sorted by frequency of presence/absence in that same subset of genomes within distance d of p1. This process is repeated for oligos within an allowable distance range d downstream (3') of p1. The oligo p2 that is either upstream or downstream that occurs in the most genomes is selected as a pair with p1, and it is checked for free energies of formation of hairpins, homodimers, and primer dimers with p1. If these free energies are not acceptable, the next most frequent oligo is selected as p2, and so on, until one can be selected that forms neither hairpins nor primer dimers. Oligos that are the reverse complement of one that has already been selected are not permitted, so as to avoid obvious primer dimer formation. If the downstream oligo is chosen, then p1 and the reverse complement of p2 are added to the universal primer set. If instead the upstream oligo is chosen, then the reverse complement of p1 and the existing p2 (not reverse complemented) are added to the universal primer set. Thus, the two primers added should work in a pair as a forward and reverse primer to amplify detectable fragments in the maximum number of target genomes. The distance d is determined by the technology used to detect the bands, e.g. for capillary electrophoresis, bands up to 1500 bp can be discriminated.

3) Determine as-yet-unamplified genomes and find next set of primers. Those genomes that yield a detectable (in the appropriate length range) band from the first two primers are stored in a "detected" pool, and all the oligos in the remaining genomes are re-sorted by the number of as-yet-undetected genomes in which they occur. The oligo p3 occurring in the most genomes is checked for hairpins and dimers, and if acceptable it is selected, and again as in step 2 all oligos within a distance d upstream or downstream of p3 are ranked by frequency and the one with the highest frequency is chosen as p4, as in step 2 determining which oligo should be reverse complemented to serve as a reverse primer of the pair. In selecting all oligos to add to the set of primers, no primers that are predicted to form hairpins or primer dimers (homodimers or dimers with other primers already in the set) are allowed. The primer p4 may be the same as one previously chosen (p1, p2, or p3), in which case the universal primer set increases by only one instead of two primers.

4) All the primers chosen thus far are compared against all of the targets, allowing any combination of primers as the forward or reverse of a pair, and those genomes in which a detectable band appears are stored in the detected pool. The steps 3-4 are repeated on the as-yet-undetected targets until sufficient primers are chosen such that at least one detectable amplicon is generated from every one of the targets.

In view of the number of viral sequence data used to create these primer sets the huge predicted viral diversity on earth, the rapid evolution of RNA and phage viruses, and the lack of cultureable viruses to characterize, it is expected, therefore, that these signatures will evolve following the process defined above at regular intervals. Despite these challenges, Applicants have computationally demonstrated the ability of this initial primer set to identify newly emerging viruses such as Ebola, SARS, Nipah, and Hendra viruses. The electrophoretic banding signatures would be identified as "unknown", or outside the existing banding library for sequenced viruses. These bands could easily be extracted and sequenced for comparison against existing genome libraries. This would create an ever-expanding library of biological viral signatures (based on fragment size) that could be used to rapidly characterize unknown samples.

Figure 4:
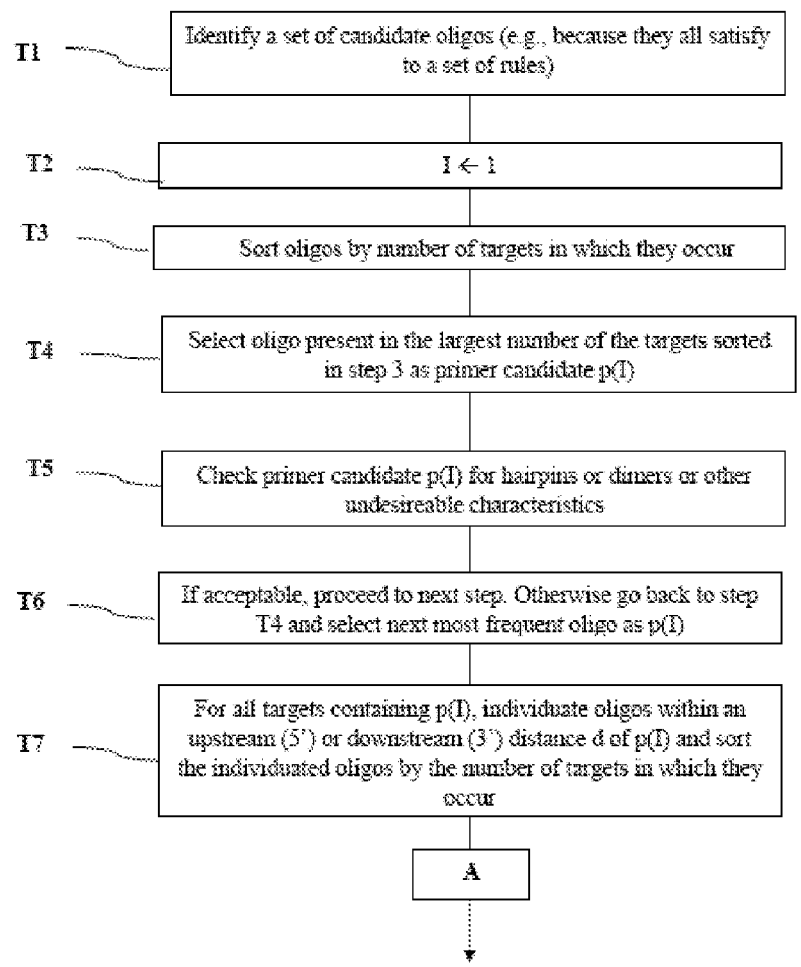
FIGS. 4 to 6 show a second exemplary algorithm to identify probe polynucleotides according to an embodiment herein disclosed.
Figure 5:
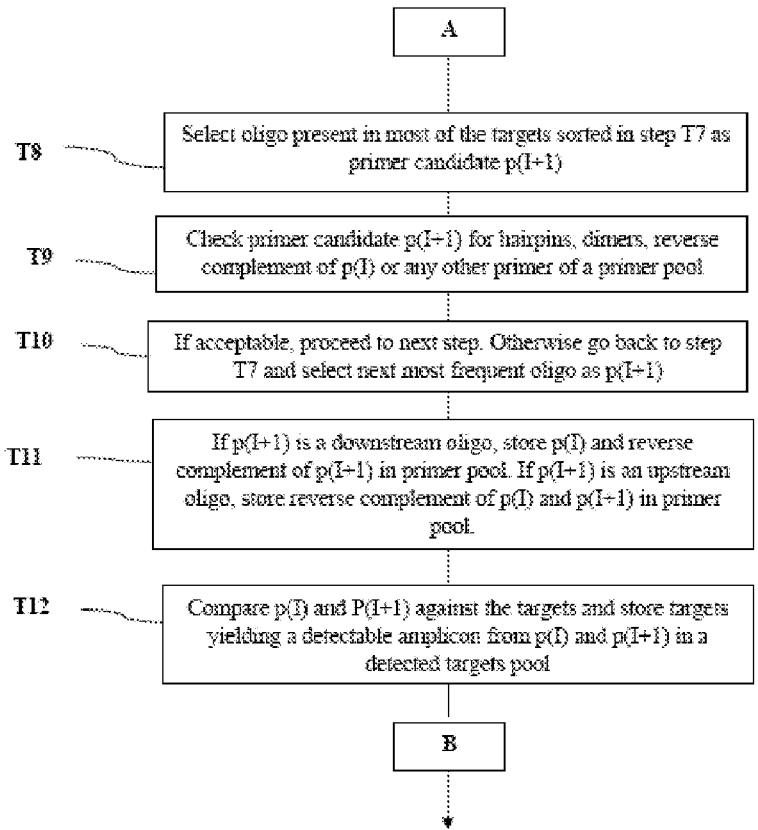
Figure 6:
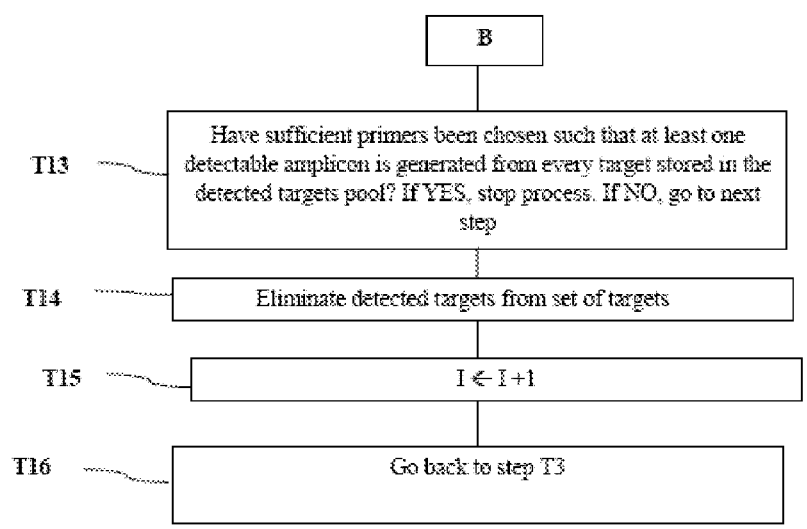

An embodiment of the present disclosure on which Example 2 is based is shown in the flowchart of FIGS. 4 to 6, which show steps T1-T16 for performing a method to identify primers suitable for detecting target microorganisms.

Example 4

Target Sets Used in Calculations of Conserved Primer Sets

Target sets used in this example are the set of all viral complete genomes and complete segments for each viral family, downloaded from publicly available sequence databases (Genbank, Baylor, TIGR) as of Oct. 29, 2007. Partial genomes were not included. Applicants' goal was to generate highly conserved family-level primer sets. There were genome sequences available for 70 of the 72 families, except for Metaviridae and Roniviridae. Draft sequences with multiple contigs were merged into a single sequence entry, with contigs separated by 1000 N's, a stretch sufficiently long (greater than $d_2$ in all but one of our runs) so that primer pairs would not be designed to fall on different contigs, although there were very few draft sequences in contigs where this was necessary. Calculations were performed on a single AMD Opteron 2.4 GHz processor with 16 or 32 GB of RAM. Run parameters are given in Table 1 of Example 1. For family-level primers, Applicants computed primer sets with primers of length 10, for binned primers in groups of b=20 primers per bin. Applicants also computed primers sets assuming unbinned primers (all primers in the set mixed in a single reaction) and removing all $T_m$ constraints.

Next, Applicants computed primers of length 17-18-mers in unbinned reactions with the $T_m$'s and other parameters as specified in Table 1 (see Example 1). Finally, Applicants designed primers of 17-20 bases in groups of 30 primers per bin, primer $T_m$=55-65° C., and with amplicon length ($d_1$ and $d_2$) 100-2000 bp.

Applicants also generated primer sets for several species with high sequence diversity: HIV-1, foot-and-mouth-disease virus (FMDV), Norwalk virus, and Influenza A segments HA and NA. To illustrate the challenges of designing primers from an alignment, Applicants aligned these organisms using MUSCLE [ref. 33] when possible. For the HIV-1 and Influenza A segments HA and NA sequences, MUSCLE ran out of memory before completing. An alternative alignment tool, Clustalw [ref. 31], had completed only a small fraction of the alignment after running for days. So for these large data sets, a random selection of ~35 sequences for each target was aligned with MUSCLE, and this alignment was used to build an HMM (hmmbuild) using HMMer (http://hmmer.wustl.edu/). [ref. 32] The full sequence set was then aligned to the HMM using hmmalign. For Norwalk virus and FMDV, Applicants designed multiplex-degenerate primer sets using Greene SCPrimer [ref. 36] and HYDEN [ref. 38].

Example 5

Primer Sets Suitable for Viral Genome Identification

The number of family-level primers for each family, and the number of genomes available for generating those primer sets, is given in Table 2, for 4 alternative parameter settings.

TABLE 2

| Family | DNA or RNA | Single (s) or double (d) stranded | Number of Genomes or Segments | Tm 35-50, 10-mers, 20 primers/bin, Amplicon length 80-620 | No bins, No Tm or GC % constraints, 10-mers, Amplicon length 80-620 | Tm 55-70, primer length 17-18, no bins, Amplicon length 80-620 | Tm 55-65, primer length 17-20, Bin size = 30, Amplicon length 100-2000 |
|---|---|---|---|---|---|---|---|
| Metaviridae | RNA | S | 0 | 0 | 0 | 0 | 0 |
| Roniviridae | RNA | s | 0 | 0 | 0 | 0 | 0 |
| Barnaviridae | RNA | s | 1 | 2 | 2 | 2 | 2 |
| Bicaudaviridae | DNA | d | 1 | 2 | 2 | 2 | 2 |
| Corticoviridae | DNA | d | 1 | 2 | 2 | 2 | 2 |
| Marnaviridae | RNA | s | 1 | 2 | 2 | 2 | 2 |
| Plasmaviridae | DNA | d | 1 | 2 | 2 | 2 | 2 |
| Globuloviridae | DNA | d | 2 | 2 | 2 | 4 | 4 |
| Lipothrixviridae | DNA | d | 2 | 4 | 2 | 4 | 4 |
| Nimaviridae | DNA | d | 3 | 2 | 2 | 2 | 2 |
| Rudiviridae | DNA | d | 4 | 4 | 2 | 4 | 4 |
| Ascoviridae | DNA | d | 5 | 4 | 2 | 4 | 4 |
| Fuselloviridae | DNA | d | 5 | 4 | 4 | 6 | 6 |
| Hypoviridae | RNA | d | 6 | 4 | 4 | 6 | 6 |
| Phycodnaviridae | DNA | d | 6 | 6 | 4 | 6 | 6 |

TABLE 2-continued

| Family | DNA or RNA | Single (s) or double (d) stranded | Number of Genomes or Segments | Tm 35-50, 10-mers, 20 primers/bin, Amplicon length 80-620 | No bins, No Tm or GC % constraints, 10-mers, Amplicon length 80-620 | Tm 55-70, primer length 17-18, no bins, Amplicon length 80-620 | Tm 55-65, primer length 17-20, Bin size = 30, Amplicon length 100-2000 |
|---|---|---|---|---|---|---|---|
| Tetraviridae | RNA | s | 6 | 8 | 8 | 12 | 12 |
| Asfarviridae | DNA | d | 8 | 2 | 2 | 2 | 2 |
| Chrysoviridae | RNA | d | 8 | 10 | 6 | 15 | 16 |
| Narnaviridae | RNA | s | 8 | 12 | 8 | 16 | 16 |
| Sequiviridae | RNA | s | 8 | 6 | 6 | 8 | 6 |
| Iridoviridae | DNA | d | 9 | 8 | 4 | 14 | 14 |
| Tectiviridae | DNA | d | 10 | 2 | 2 | 4 | 4 |
| Bornaviridae | RNA | s | 11 | 2 | 2 | 2 | 2 |
| Leviviridae | RNA | s | 11 | 8 | 8 | 13 | 14 |
| Birnaviridae | RNA | d | 12 | 12 | 10 | 16 | 16 |
| Cystoviridae | RNA | d | 12 | 14 | 12 | 24 | 22 |
| Astroviridae | RNA | s | 13 | 6 | 6 | 12 | 12 |
| Tymoviridae | RNA | s | 16 | 10 | 8 | 22 | 20 |
| Nodaviridae | RNA | s | 18 | 20 | 16 | 22 | 22 |
| Dicistroviridae | RNA | s | 19 | 20 | 12 | 24 | 24 |
| Inoviridae | DNA | s | 28 | 22 | 14 | 32 | 32 |
| Totiviridae | RNA | d | 29 | 28 | 24 | 46 | 46 |
| Filoviridae | RNA | s | 35 | 6 | 4 | 5 | 6 |
| Comoviridae | RNA | s | 36 | 34 | 22 | 48 | 48 |
| Nanoviridae | DNA | s | 36 | 28 | 17 | 37 | 40 |
| Partitiviridae | RNA | d | 36 | 42 | 35 | 60 | 58 |
| Closteroviridae | RNA | s | 37 | 32 | 20 | 46 | 48 |
| Baculoviridae | DNA | d | 41 | 16 | 10 | 38 | 33 |
| Caulimoviridae | DNA | d | 46 | 32 | 18 | 48 | 48 |
| Arteriviridae | RNA | s | 49 | 6 | 6 | 12 | 12 |
| Luteoviridae | RNA | s | 49 | 10 | 8 | 18 | 20 |
| Podoviridae | DNA | d | 60 | 34 | 30 | 66 | 66 |
| Rhabdoviridae | RNA | s | 60 | 24 | 18 | 40 | 40 |
| Tombusviridae | RNA | s | 61 | 31 | 24 | 60 | 54 |
| Myoviridae | DNA | d | 62 | 36 | 29 | 78 | 66 |
| Hepeviridae | RNA | s | 65 | 4 | 4 | 8 | 8 |
| Parvoviridae | DNA | s | 68 | 34 | 26 | 56 | 54 |
| Adenoviridae | DNA | d | 71 | 20 | 14 | 32 | 30 |
| Herpesviridae | DNA | d | 79 | 22 | 20 | 58 | 48 |
| Bromoviridae | RNA | s | 80 | 55 | 44 | 108 | 91 |
| Caliciviridae | RNA | s | 80 | 26 | 20 | 50 | 44 |
| Flexiviridae | RNA | s | 100 | 59 | 42 | 125 | 98 |
| Papillomaviridae | DNA | d | 100 | 44 | 21 | 103 | 97 |
| Arenaviridae | RNA | s | 103 | 38 | 21 | 93 | 80 |
| Microviridae | DNA | s | 105 | 10 | 6 | 14 | 12 |
| Togaviridae | RNA | s | 105 | 20 | 10 | 32 | 31 |
| Poxviridae | DNA | d | 133 | 16 | 6 | 22 | 20 |
| Paramyxoviridae | RNA | s | 159 | 36 | 26 | 60 | 56 |
| Siphoviridae | DNA | d | 162 | 69 | 45 | 145 | 130 |
| Potyviridae | RNA | s | 196 | 41 | 26 | 119 | 106 |
| Polydnaviridae | DNA | d | 230 | 181 | 80 | 331 | 333 |
| Coronaviridae | RNA | s | 237 | 13 | 10 | 24 | 24 |
| Circoviridae | DNA | s | 336 | 14 | 14 | 26 | 25 |
| Picornaviridae | RNA | s | 426 | 34 | 28 | 67 | 56 |
| Geminiviridae | DNA | s | 427 | 55 | 36 | 167 | 126 |
| Polyomaviridae | DNA | d | 499 | 20 | 10 | 28 | 24 |
| Flaviviridae | RNA | s | 522 | 34 | 26 | 81 | 68 |
| Reoviridae | RNA | d | 869 | 634 | 360 | >319 (58%)* | 866 |
| Hepadnaviridae | DNA | d | 975 | 6 | 6 | 8 | 12 |
| Bunyaviridae | RNA | s | 1010 | 207 | 125 | 449 | 326 |
| Retroviridae | RNA | s | 1348 | 64 | 44 | 164 | 124 |
| Orthomyxoviridae | RNA | s | 25237 | 236 | 145 | >242 (95%)* | 397 |

*Run did not complete in allotted time (100 hours). >319 (58%) indicates that with 319 primers, 58% of the target genomes were amplified.

Hypothetically, the worst case scenario to amplify a target set of N sequences would require 2N primers. MPP requires on average only 26%, 33%, 47% or 48% of this number for primers of length 10 nt without $T_m$ constraints, 10 nt with $T_m$ constraints, 17-18 nt, and 17-20 nt, respectively (averages across families for each column of Table 2). The most diverse families, in particular Reoviridae, Orthomyxoviridae (including all sequenced segments of influenza as well as other viruses in the family), Bunyaviridae, and Polydnaviridae, require so many primers that actually applying family-level amplification may well be infeasible. For these, more restricted target sets may be necessary, and possibly the incorporation of primers with degenerate or inosine bases. Some families with many genomes can be amplified with relatively few primers, such as Coronaviridae, Hepadnaviridae, Poxviridae, Togaviridae, Microviridae, and Polyomaviridae. All primer sequences are available in Appendix A.

Figure 9:
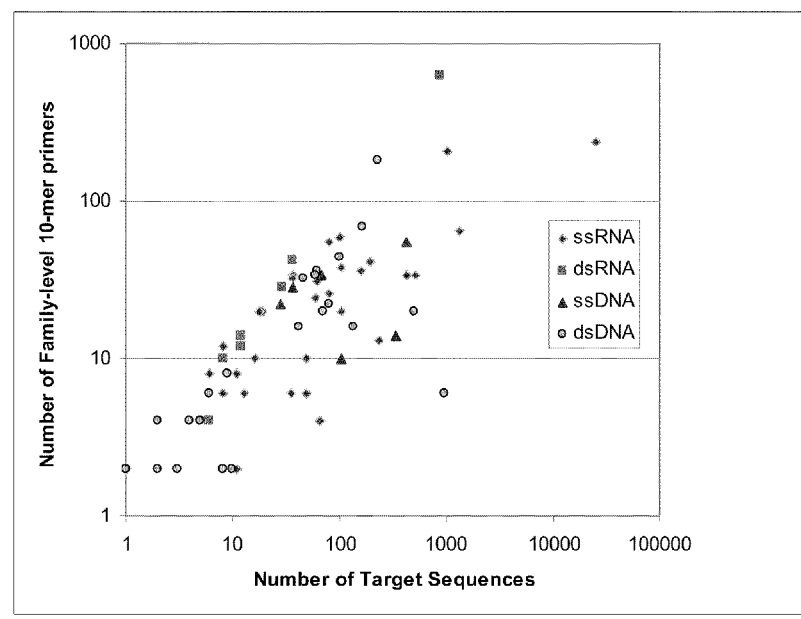
FIG. 9 shows a diagram plotting the number of primers required to amplify fragments from each complete genome or segment in a viral family versus the number of available sequences in that family. Primer numbers were for 10-mers, $T_m$ between 35-50° C., binned in groups of 20 primers/bin.

The size of the family-level primer set increases with the number of sequences in the family (FIG. 9, p=0.003, least squares fit). The number of primers in the set is not significantly affected by whether the genomes are RNA or DNA (p=0.08) or double or single-stranded (p=0.11, interaction term for DNA/RNA×ds/ss has p=0.07), although the plot indicates there is a trend for dsRNA genomes to require relatively more primers when controlling for the effect of the number of target sequences available.

Primer design with the software described above indicates that relatively few primers are required to amplify all sequenced genomes of HIV-1, FMDV, and Norwalk virus (Table 3).

TABLE 3

| Virus Species | Number of sequences | Number of 10-mers | Number of 17-18-mer primers in set | Longest conserved region from MSA (nt) |
|---|---|---|---|---|
| NA segment of Influenza A* | 6375 | 52 | 120 | 5 |
| HA segment of Influenza A* | 5440 | 73 | 153 | 1 |
| HIV-1 | 1175 | 6 | 16 | 0 |
| FMDV | 187 | 4 | 6 | 9 |
| Norwalk | 41 | 7 | 20 | 6 |

*For Influenza A HA and NA segments, all complete sequences, including lab strains, from all hosts, countries, and serotypes were downloaded from the NCBI Influenza Virus Resource database on Jan. 18, 2008.

Influenza A HA and NA segments demand large numbers of 10-mer or 17-18-mer primers, so one could break these into subgroups, possibly by serotype, as shown for several HA serotypes in Table 4.

TABLE 4

| Influenza A HA Serotype | Number of sequences | Number of 18-mer primers in set |
|---|---|---|
| H1 | 1080 | 24 |
| H2 | 108 | 8 |
| H3 | 1972 | 15 |
| H5 | 1325 | 16 |
| H7 | 256 | 8 |

Figure 10:
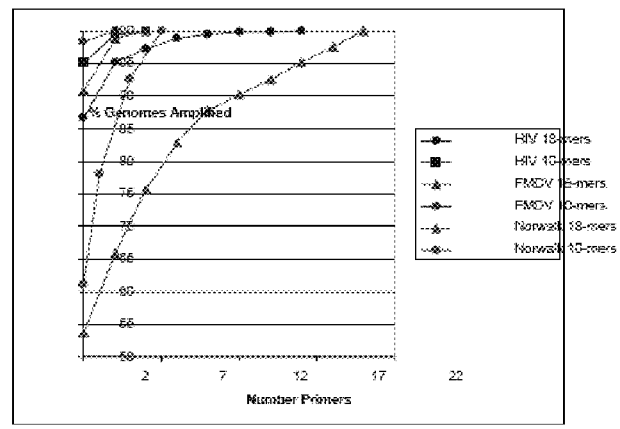
FIG. 10 shows a diagram plotting the percentage of genomes amplified versus the number of primers required, for primers of either 10-mers or 17-18-mers, for virus species HIV-1, FMDV, and Norwalk, according to an embodiment herein disclosed.
Figure 11:
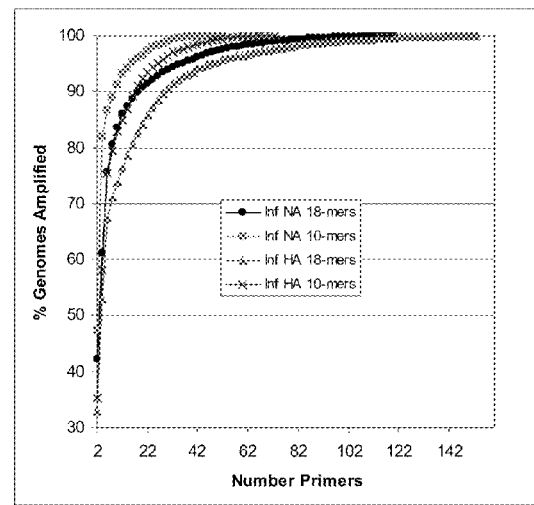
FIG. 11 shows a diagram plotting the percentage of genomes amplified versus the number of primers required, for primers of either 10-mers or 17-18-mers, for virus species Influenza A HA and NA segments, according to an embodiment herein disclosed.

The percentage of genomes amplified versus the number of primers used, for primers of either 10-mers or 17-18-mers, is shown in FIGS. 10 and 11. These plots show that a large fraction of targets are amplified with only 2 primers, and the addition of subsequent primers shows diminishing returns in amplifying fewer, more divergent targets not detected by the initial, more conserved, primer pair.

The more traditional method of attempting to find primers from a multiple sequence alignment would be problematic, probably requiring manually designed primer multiplexes or highly degenerate primers. For HIV-1, for example, there is not a single position with 100% conservation across all sequenced isolates. Dropping the required conservation down to 95% (58 of the 1175 genomes could disagree with a consensus base at any position), there are 3 conserved regions of at least 18 bases, with positions relative to the consensus: ACAGGAGCAGATGATACAGTA (SEQ ID NO: 11,335) starting at position 3665; TATGGAAAACAGATGGCAGG (SEQ ID NO: 11,336) starting at 7347; and CTATGGCAGGAAGAAGCG (SEQ ID NO: 11,337) starting at 9071. These regions are too far apart to be used as primers for most polymerases used in diagnostic PCR protocols, where amplicons must typically be less than 300 bases long for efficient amplification. A recently published study [ref. 30] selected primers from the 5' LTR U5 end to the Gag-Pol start (5'-TAGCAGTGGCGCCCGA-3' (SEQ ID NO: 11,338) and 5'-TCTCTCTCCTTCTAGCCTCCGC-3' (SEQ ID NO: 11,339), but a comparison against available genomic data indicates that 487 of the 1175 genomes (41%) do not contain a sequence match for this primer pair, so may fail to be amplified.

For Influenza A segment HA, the size of the longest conserved region from the 95% consensus is only 5 bases, and for segment NA, only 6 bases, insufficient for even a single primer. For FMDV and Norwalk virus, the longest 100% conserved regions are 9 and 6 bases, respectively, too short for a primer. Thus, for highly diverse and large targets such as these, one option for primer design is careful manual selection by an expert in multiplex and/or degenerate PCR. Applicants tried several freely available tools, and found that they had difficulty scaling for large target sets (see below). MPP software makes it straightforward for a non-expert to determine a multiplex-compatible set of conserved primers, even for enormous and heterogeneous target sets that cannot be aligned.

For comparison, Applicants considered other software options for designing primers for these heterogeneous viruses. Applicants tried Primaclade® [ref. 34], but the web server timed out for Norwalk and FMDV alignments. The link to the MuPlex [ref. 40] server was not functional, and in any case the file size limit of 500 Kb would have been exceeded by all but the Norwalk data set. The PDA-MS/UniQ software [ref. 35] was not available for download or on a public web server. CODEHOP [ref. 41] requires protein alignment as input so is not appropriate for whole-genome (nucleotide) alignments.

SCPrimer [ref. 36] did generate a number of degenerate primer candidates from the multiple sequence alignment, requiring the user to manually select a combination of forward and reverse groups from a set of options. Applicants ran SCPrimer using length, $T_m$, etc. settings mirroring or more lenient than those Applicants used for Table 3 ($T_m$=55-65° C., GC %=20-80%, length 17-25 bp, 100% coverage, product size 80-620 bp, allowed $T_m$ difference 10° C., others left as defaults). HYDEN [ref. 38] also generated degenerate candidates from the multiple sequence alignment, although it does not check $T_m$ and the length is limited to a single value rather than a range (Applicants set it at 18 rather than 17 because of the lack of $T_m$ control, and allowed 0 mismatches). The SCPrimer option requiring the fewest total primers for the Norwalk set required 18 primers, 4 of which had either 2-fold or 4-fold degeneracy so the actual number of priming sequences would be 26, compared to a total of 20 non-degenerate primers predicted by MPP (Supplementary information). HYDEN generated 4 degenerate primers covering only 34 of 41 sequences, each with 3- or 4-fold degeneracy for Norwalk, which translates to 15 priming sequences in the reaction. Small degenerate priming sets (e.g. 4 primers in this case) are less expensive to purchase, but because of dilution effects from the many sequence combinations actually present (15 priming sequences in the PCR), sensitivity may be reduced compared to nondegenerate priming.

One would need to manually find primers to amplify the remaining seven sequences. For FMDV, SCPrimer generated a number of candidates, and manual inspection identified that the best of those primer combinations would require 6 primers, one of which had 2-fold and another had 3-fold degeneracy, totalling 9 actual priming sequences in a reaction (Appendix A). This compares with 2 primers each with 4-fold degeneracy using HYDEN (8 priming sequences in a reaction), to amplify 98% (183 of 187) targets, and 6 non-degenerate multiplex compatible primers for FMDV using MPP.

Example 6

Calculating Highly Conserved, Multiplexed Primer Sets

Here, Applicants outline a greedy algorithm used to calculate conserved sets of multiplexed primers to amplify fragments from each member of a target set of sequences. An exemplary source code is enclosed herewith as Appendix E incorporated herein by reference. First, Applicants enumerate all candidate oligos fitting requirements for length, $T_m$ (see Table 5), and lack of hairpin formation (minimum hairpin $\Delta G$ was −5 kcal/mol).

TABLE 5

$T_m$ (° C.) settings used in predicting universal primer sets

| | Length | | | | | | | | | | | | |
|---|---|---|---|---|---|---|---|---|---|---|---|---|---|
| | 6 | 7 | 8 | 9 | 10 | 11 | 12 | 13 | 14 | 15 | 16 | 17 | 18 |
| $T_m$ min | 10 | 25 | 30 | 35 | 35 | 35 | 35 | 40 | 45 | 50 | 50 | 50 | 50 |
| $T_m$ max | 35 | 40 | 45 | 50 | 50 | 50 | 50 | 55 | 60 | 65 | 70 | 70 | 70 |

Applicants rank pairs of these by the number of targets in which that pair occurs within a distance d of one another, and the most frequent pair is selected as primers.

The process is repeated for the remaining targets that would not have an amplicon from the first pair, with the added consideration that new oligos selected be predicted not to form dimers with other primers already in the bin, based on nearest neighbor thermodynamic predictions [ref. 16], allowing a primer dimer minimum $\Delta G$ of −7 kcal/mol. Primers are added to a bin until that bin contains 20 primers, at which point a new bin is begun, following the same process. Binning primers in groups of 20 avoids exclusion of the most highly conserved oligos because of primer dimer free energy constraints. In other embodiments, other bin sizes may be desired, and primer sets can be built by specifying more or fewer primers per bin.

Figure 7:
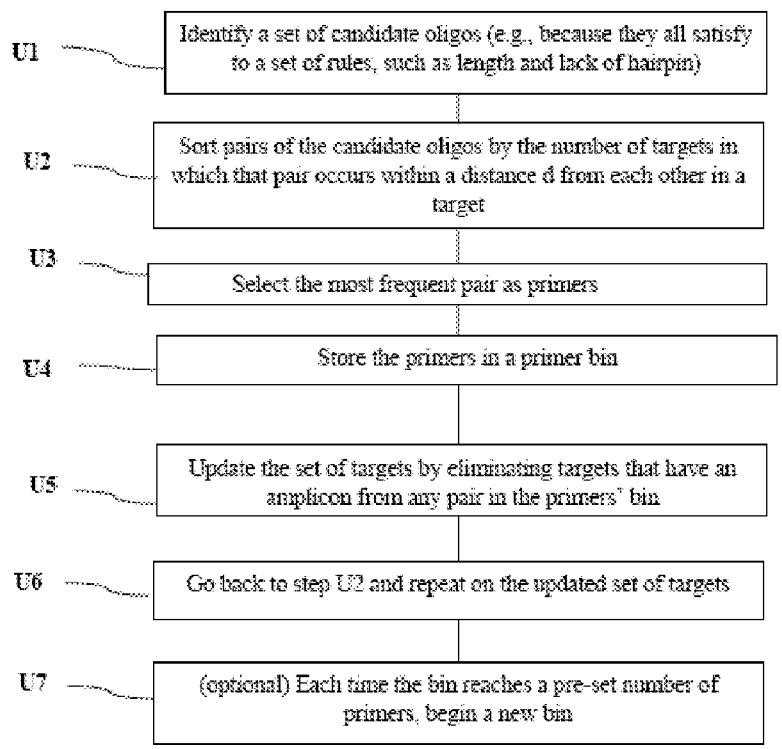
FIG. 7 shows a third exemplary algorithm to identify probe polynucleotides according to an embodiment herein disclosed.

An embodiment of the present disclosure on which Example 6 is based is shown in the flowchart of FIG. 7, which shows steps U1-U7 for performing a method to identify primers suitable for detecting target microorganisms.

The universal set of primers is the set of selected primers to amplify all genomes in the target set. The primers within a bin should be multiplexed into a single PCR reaction, but each bin run separately. Applicants calculated universal primers of length 5-18, and analyzed how primer length affects the number of primers in the universal set. The allowable range for distance d used here was between 80 and 620 bases, as this is reasonable for electrophoretic discrimination of bands or sequencing.

Figure 12:
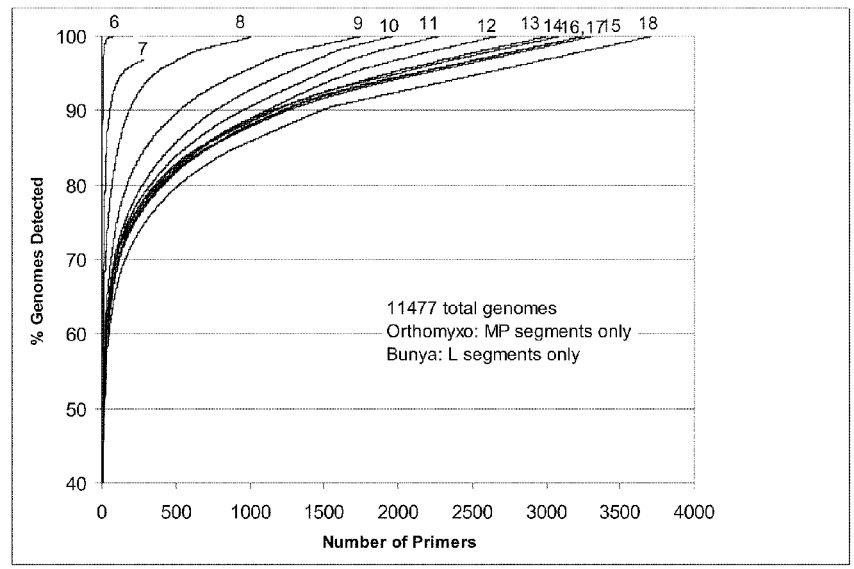
FIG. 12 shows a diagram plotting the percent of viral genomes detected vs. number of primers required, for primers of different sizes based on all available viral genomes, using sequence data as of Apr. 25, 2007.

The number of primers in a universal viral set such that all viral genomes generate at least one amplicon is shown in FIG. 12. For segmented viruses, primers were designed so that an amplicon from each segment should be amplified, except for the case of Orthomyxovirida, in which primers were designed to only ensure amplification of MP segments, and Bunyaviridae, in which primers were designed to only ensure amplicons from L segments. With 10-mer primers, 1974 primers are required to detect all viral genomes, but this number drops by over half, down to 764 primers, if it is sufficient to detect only 90% of viral targets. For 9-mers, 1754 and 525 primers are required to detect 100% or 90%, respectively. Using longer primers such as 15-mers requires 3318 primers for 100% or 1246 primers for 90%. Requiring 7-mers with $25°\le T_m\le 40°$ C., it is not possible to amplify all target genomes, since many do not contain pairs of 7-mers in the required $T_m$ range within a PCR-amplifiable distance of one another. $T_m$ constraints demand larger universal primer sets (FIG. 13) since some highly conserved primers may be eliminated because of $T_m$'s outside the allowable range.

Figure 13:
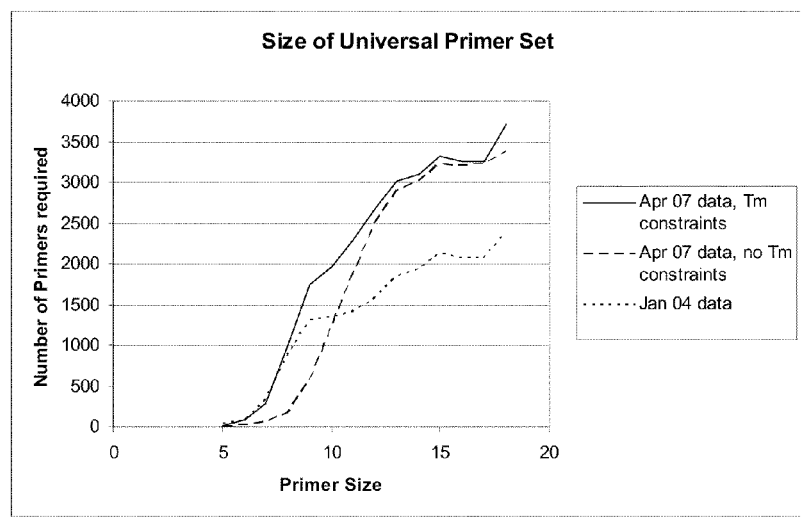
FIG. 13 shows a diagram plotting the number of primers in the universal set for all viruses, as a function of primer size, based on sequence data available April 2007 and imposing $T_m$ constraints in primer selection, without $T_m$ or GC % constraints, and based on January 2004 sequence data with $T_m$ constraints. For primer size of 5 with $T_m$ constraints, a constraint of $T_m>0$ was used, delivering primers with GC % of 80-100%.

This is particularly true for shorter primers, since short primers more often fall below the allowable $T_m$ range. In FIG. 13, the solid and dotted curves with $T_m$ constraints are jagged because of the arbitrary increment in allowable $T_m$ range that was specified for primers of different lengths. Removing any primer $T_m$ or GC % constraints, the number of primers in a universal set for all viruses can drop by up to 83%: for 8-mer primers, the size of the universal set is 1000 primers or 172 primers for runs with $T_m$ constraints versus without, respectively. The magnitude of this advantage is greater for shorter primers, which have low $T_m$'s to begin with. Protocols for specific PCR amplification using short, low-$T_m$ primers could be advantageous.

If primers are not separated into reaction bins of 20 primers/bin, and instead all mixed in a single reaction, using 10-mers, Applicants predict that 1008 primers would be required to ensure amplification of at least one fragment 80-620 bp from every viral genome. This is a savings of almost 50% of the total number of primers required, compared to binning the reactions. To ensure that this computation would complete, Applicants relaxed the primer dimer minimum $\Delta G$ to −11 (from −7 kcal/mol for the binned runs), and the calculation required 776 hrs.

Another alternative (to removing $T_m$ constraints or combining primers in a single, unbinned reaction) for reducing the number of primers is to allow primer length variation while maintaining $T_m$ within a specified range, although this requires substantially more memory to calculate. There was not enough memory to compute a universal set allowing primers of lengths between 12-15 bases on a 32 MB node. A universal set of 12-14-mers with $40°\le T_m\le 55°$ C. requires 2805 primers grouped into 140 reaction bins, a savings of ~200 primers compared to 13-mers alone with the same $T_m$ range (3015 primers). Similarly, a universal viral set of primers ranging in size from 9-11-mers gives a savings of ~200 primers compared to fixed length primers of size 9-mers with the same $T_m$ range ($T_m$ of 35-50° C., 1561 versus 1754 primers).

It is predicted that ~2000 primers of length 10 would be required to amplify fragments from all currently sequenced viruses, or ~3700 primers of length 18. With primers longer than 10 bases, however, it is likely that newly emerging, unsequenced viruses would go undetected Example 7

Genome Targets Used in Calculations

Viral Genomes

Our target set for the calculation of Example 6 was the set of all viral genomes and segments, using only the MP segment from Orthomyxoviridae and the L segment of Bunyaviridae, in order to limit the overrepresentation of these families, totaling 11,477 sequences on Apr. 25, 2007, when Applicants compiled the data. Including the MP segment and L segment of Orthomyxoviridae and Bunyaviridae, respectively, would have resulted in a total of 34,494 sequences, illustrating the large representation of those families in viral sequence databases. Draft sequences with multiple contigs were merged into a single sequence entry, with contigs separated by 1000 N's, a stretch sufficiently long (>d) so that primer pairs would not be designed to fall on different contigs.

Each calculation was performed on a single AMD Opteron 2.4 GHz processor with 16-32 GB of RAM. The total compute hours to generate the results described here was over 11,000 cpu-hours, taking advantage of high performance computing facilities at Lawrence Livermore National Laboratory.

Thus, viruses pose a unique challenge compared to bacteria, where 16s rRNA primers are highly conserved across the bacterial kingdom. Random amplification and sequencing of a few 100 nt fragments from an unknown virus is an alternative approach that is predicted to successfully characterize newly emerged viruses. Targeted amplification with a single or few (<10) pentamer or hexamer priming sequences is another possible strategy for viral amplification for detection/characterization that may work if the specific pentamers or hexamers are chosen wisely.

Example 8

Figure 15:
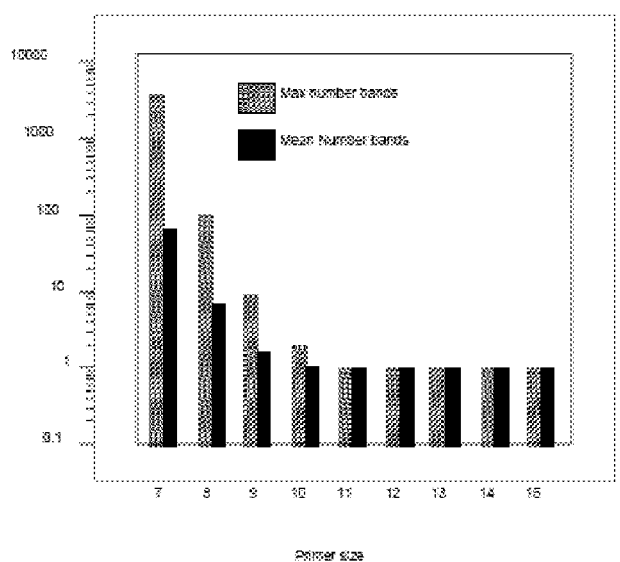
FIG. 15 shows a block diagram illustrating the maximum number of bands and mean number of bands per genome in a bin as a function of primer size, predicted using the universal primer sets for all viral genomes and segments as indicated in FIG. 12.

Virus Detection Through Viral Genome Identification from Universal Viral Primer Sets To deconvolute and characterize the PCR products, there must not be too many different amplicons per genome if the backend is via fragment length distributions, mass spectrometry, or sequencing (although microarray hybridization might be more flexible in this regard). One could envision that 1-10 amplicons per genome would allow adequate discrimination of genomes. Universal viral primer sets of size 7 or 8-mer primers result in 10's to 1000's of different amplicons per genome per bin, since multiple primers bind (some more than once) to each genome (FIG. 15). 9-mers generate approximately 1-10 amplicons for most genomes, and 10-15-mers usually generate only a single band. Using unbinned 10-mer primers run all within a single reaction (the set of 1008 primers described above), the mean and maximum number of amplicons per genome are 13.2 and 948, respectively, compared to a mean of 1 and maximum of 2.9 amplicons per genome using the 10-mers binned into groups of 20 primers/bin. So by using a larger multiplexed reaction, not only might primer multiplexing be more difficult, but also deconvoluting the products might be more challenging.

Example 9

Family Identification by Sequencing Fragments Amplified Using a Universal Primer Set The products of amplification using a universal viral primer set could be sequenced, so the question arises of whether the amplified fragments can provide family-level characterization of unknown, newly emerged viruses.

Figures 17, 18:
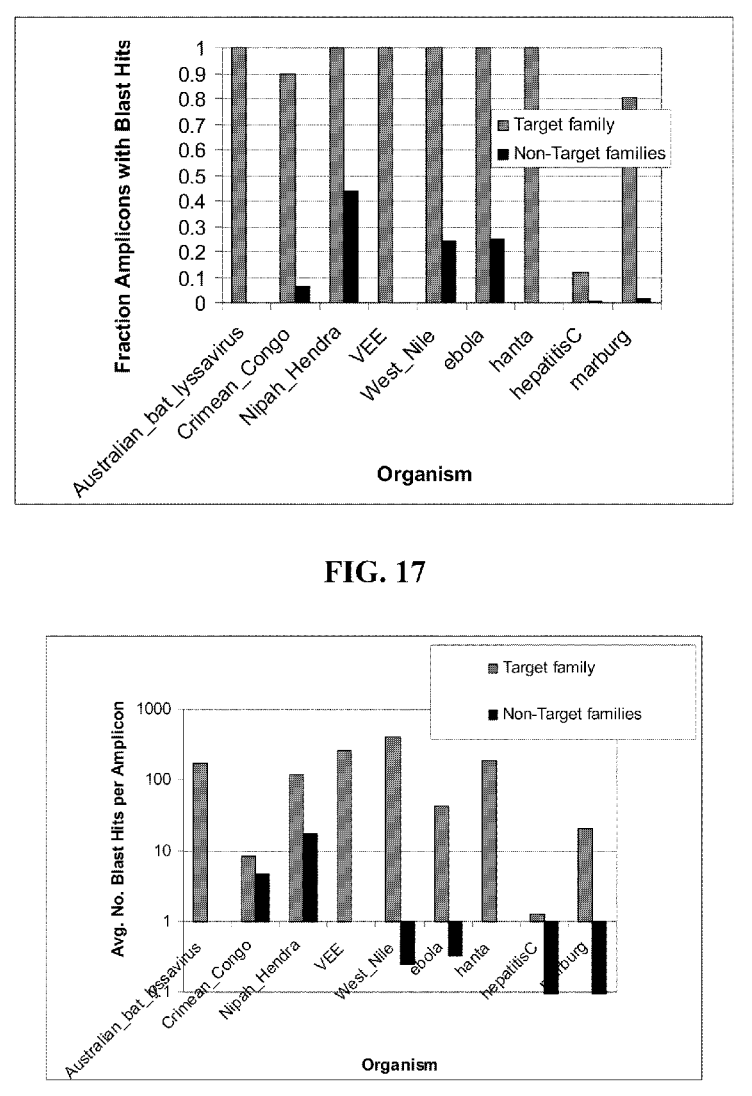

Applicants extracted the sequence of the amplicons that should be generated using specific amplification with the universal 10-mer set and BLASTed those amplicon sequences against either other species in the same target family or viruses in other families (FIGS. 17 and 18).

This shows that on average 87% of the amplicons have BLAST hits in the correct family, with an average of 135 hits per amplicon. In contrast, only 11% of amplicons have BLAST hits in other, non-target families, with an average of 2.5 BLAST hits per amplicon Example 10

Identification of Unknown Viruses

To determine the likelihood of detecting unknown/unsequenced viruses, Applicants performed the following simulations. The 29 most recently emerged species of viruses [ref. 14, 28] and their very similar subsequently discovered near neighbors (Table 6) were excluded from the target set of genomes, leaving 9741 sequences.

TABLE 6

Reference sequences of newly emerged viruses

Arenaviridae ref|NC_005077, NC_005082|Guanarito virus

Arenaviridae ref|NC_004296, NC_004297|Lassa virus

Arenaviridae ref|NC_006572, NC_006573|Mopeia Lassa reassortant 29

Bunyaviridae ref|NC_005215, NC_005216, NC_OO5217|Sin Nombre virus

Bunyaviridae ref|NC_005226, NC_005227, NC_005228|Tula virus, complete

Bunyaviridae ref|NC_005300, NC_005301, NC_005302|Crimean-Congo hemorrhagic fever virus Bunyaviridae ref|NC_003466, NC_003467, NC_003468|Andes virus Bunyaviridae ref|NC_002043, NC_002044, NC_002045|Rift Valley fever virus Coronaviridae ref|NC_004718.3|gnl|NCBI_GENOMES|17014|gi|30271926|SARS coronavirus Dicistroviridae ref|NC_003005.1|gnl|NCBI_GENOMES|15715|gi|14780876|Taura syndrome virus Filoviridae ref|NC_006432.1|gnl|NCBI_GENOMES|18041|gi|55770807|Sudan ebolavirus Filoviridae ref|NC_002549.1|gnl|NCBI_GENOMES|15507|gi|10313991|Zaire ebolavirus Filoviridae ref|NC_001608.2|gnl|NCBI_GENOMES|10467|gi|13489275 Lake Victoria marburgvirus Filoviridae ref|NC_004161.1|gnl|NCBI_GENOMES|16606|gi|22789222 Reston Ebola virus Flaviviridae ref|NC_001563.2|gnl|NCBI_GENOMES|10411|gi|11528013 West Nile virus Flaviviridae ref|NC_001437.1|gnl|NCBI_GENOMES|10160|gi|9626460|Japanese encephalitis virus TABLE 6-continued Reference sequences of newly emerged viruses

```
Flaviviridae ref|NC_004102.1|gnl|NCBI_GENOMES|16556|gi|22129792|Hepatitis C virus Hepeviridae ref|NC_001434.1|gnl|NCBI_GENOMES|10157|gi|9626440|Hepatitis E virus Paramyxoviridae ref|NC_002728.1|gnl|NCBI_GENOMES|15627|gi|13559808|Nipah virus Paramyxoviridae ref|NC_007620.1|gnl|NCBI_GENOMES|19015|gi|82712717|Menangle virus Paramyxoviridae ref|NC_001906.2|gnl|NCBI_GENOMES|13716|gi|29468603|Hendra virus Paramyxoviridae ref|NC_004074.1|gnl|NCBI_GENOMES|16538|gi|22003842|Tioman virus Retroviridae gi|1906382|gb|K03455.1|HIVHXB2CG Human immunodeficiency virus type 1 (HXB2),
complete genome; HIV1/HTLV-III/LAV Retroviridae ref|NC_00 1870.1|gi|9629914|gnl|NCBI_GENOMES|13303|Simian-Human immunodeficiency
virus Retroviridae ref|NC_001722.1|gnl|NCBI_GENOMES|10902|gi|9628880|Human immunodeficiency virus Retroviridae ref|NC_001802.1|gnl|NCBI_GENOMES|12171|gi|9629357|Human immunodeficiency virus Rhabdoviridae ref|NC_003243.1|gnl|NCBI_GENOMES|15865|gi|17158068|Australian bat lyssavirus Togaviridae ref|NC_001786.1|gnl|NCBI_GENOMES|11742|gi|9629246|Barmah Forest virus Togaviridae ref|NC_001449.1|gnl|NCBI_GENOMES|10176|gi|9626526|Venezuelan equine encephalitis
virus
```

Then sets of universal primers of lengths 7-15 were generated for this subset of sequence data that excluded the newly emerged viruses. These primers were then compared to each of the reference sequences of the newly emerged species, and the fraction that would have been detected was calculated (FIG. 16).

For 10 newly emerged viruses, the amplicon sequences predicted using the conserved universal set of 10-mer primers (as calculated for FIG. 12) were BLASTed against other species from the same family, and also against sequences from other families. The fraction of amplicons with BLAST hits in the correct target family was compared to the fraction with hits to incorrect, non-target families (FIG. 13). This estimates the ability of the conserved universal 10-mer primer set to correctly characterize newly emerging viruses as to family.

Figure 16:
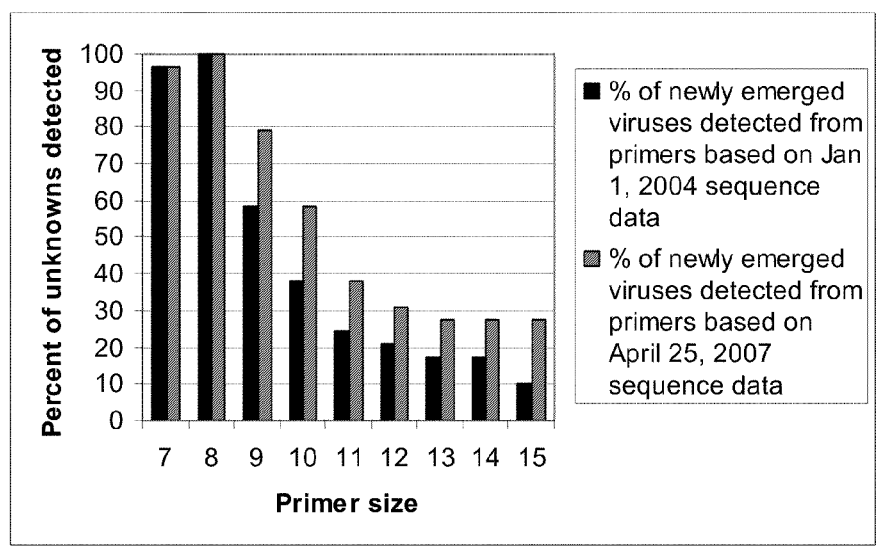
FIG. 16 shows a block diagram illustrating the percent of newly emerged ("unknown" viruses) that would have been detected based on sequence data available as of Jan. 1, 2004 or Apr. 25, 2007, as a function of primer length.

The ability to detect/discover uncharacterized or newly emerged viruses using viral universal primer sets depends strongly on primer size (FIG. 16). With 7 to 9-mers, Applicants' simulations indicate that the majority of newly emerged viruses would be detected, which in this case means that an amplicon should be generated. With 10-mers, more than half would have been detected. With primers longer than 10 bases, however, our simulations indicate that it is more likely that these newly emerged viruses would not have been detected. The amount of sequence data used to generate the universal primer sets also plays a role, such that with 9-10-mers, about 20% more newly emerged viruses could be detected (in the absence of sequence information for those unknowns and their subsequently discovered near neighbors) using primer sets generated in 2007 than in 2004.

Example 11

Effect of Increasing Availability of Sequence Data on Universal Primer Sets

Applicants evaluated how the growth of sequence availability could affect the size of the universal set, as well as our ability to detect unknown/unsequenced viruses, by compiling all viral genomes and segments available as of Jan. 1, 2004, totaling 9965 sequences. It was not necessary to exclude any Orthomyxoviridae or Bunyaviridae segments, because these sequences were not so deeply sequenced at that time.

Figure 14:
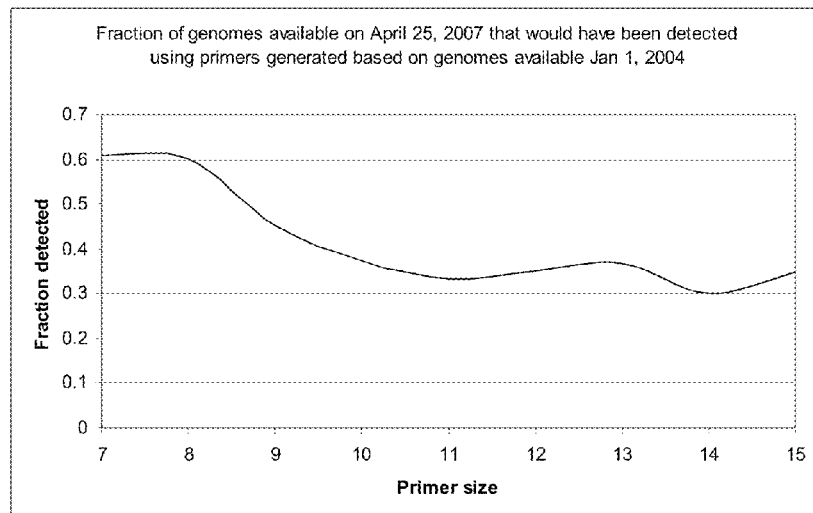
FIG. 14 shows a diagram plotting the fraction of viral genomes available on Apr. 25, 2007 that would have been detected using primer sets developed based on the sequence data available on Jan. 1, 2004.

First Applicants generated universal primer sets using all the data (FIG. 12). Applicants then determined how much of the 2007 sequence data would have been detectable using the 2004 primer sets (FIG. 14). In addition, Applicants excluded the newly emerged species as described above, generated universal sets, and determined how many of the newly emerged sequences Applicants would have been able to detect in January 2004 if Applicants had not had their sequences for designing the universal primer sets (FIG. 16).

The increase in sequence data between 2004 and 2007 requires approximately 700 more 10-mer primers to amplify all sequenced viruses in 2007 compared to 2004 (FIG. 13). While the increase in the number of sequences used between the two dates was only ~15%, the number of primers required increased by 48%, illustrating the substantial increase in diversity represented by the additional sequence data. Using universal primer sets generated using the 2004 sequence data, comparison against the 2007 sequence data indicate that only ~35% of the genomes sequenced in 2007 would have been detected using a set of 10 to 15-mer primers (FIG. 14). Shorter primers increase this fraction to over 60%, due to the higher likelihood of occurrence and conservation of shorter oligos.

Example 12

Random Amplification and Sequencing

An alternative strategy to specific amplification using universal primers is to perform amplification and sequencing of a few, randomly chosen fragments. To determine whether the sequences of randomly selected fragments of a specified length are likely to provide correct family classification of an unknown virus, simulations were performed by randomly selecting 10 fragments per length from each available genome of 10 newly emerged species (Australian bat lyssavirus, Crimean Congo hemorrhagic fever, Nipah, Hendra, Venezuelan equine encephalitis, West Nile, Ebola, Hanta, hepatitis C, and Marburg viruses), totalling 7250 fragments per length.

Each fragment was BLASTed against viruses in other families (non-target families), and also against viruses in the same family other than the species from which the fragments were derived. For Nipah and Hendra, since they are genetically so similar, both were excluded from the target family for BLASTing either of their fragments (i.e. they were treated as a single species).

Using tblastx, a positive BLAST hit required an e-value no more than 0.001 and a hit length of at least 17 amino acids (at least half the length of a 100 nt fragment, when translated to 33 amino acids). Results are plotted in FIGS. 19 and 20. To correct for disparities in the number of genomes per species, the average number of fragments with BLAST hits to target or non-target families was calculated for each species, and an overall mean h was calculated per fragment length from the mean values of all species.

Figure 20:
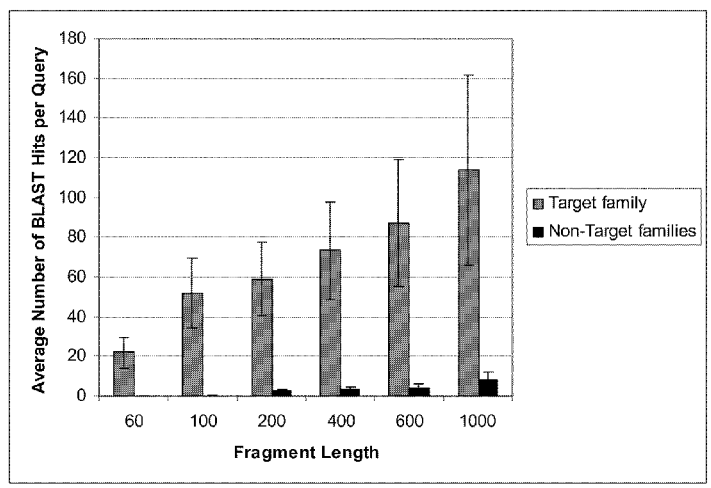
FIG. 20 shows a block diagram illustrating fragments of the lengths indicated, randomly chosen from the genomes of 9 newly emerged virus species and BLASTed against other viruses in the same (target) family or viruses in other (non-target) families are plotted against the average number of BLAST hits per fragment (+/− standard errors).
Figure 21:
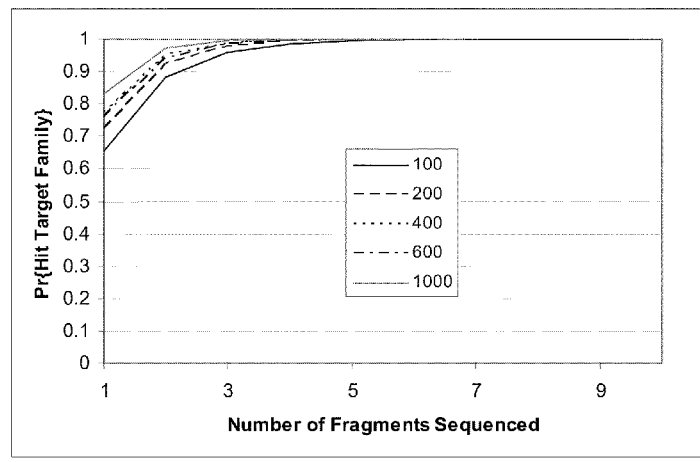
FIG. 21 shows a diagram illustrating the probability that at least one fragment has BLAST hits to the correct target family, calculated as indicated in the text.
Figure 22:
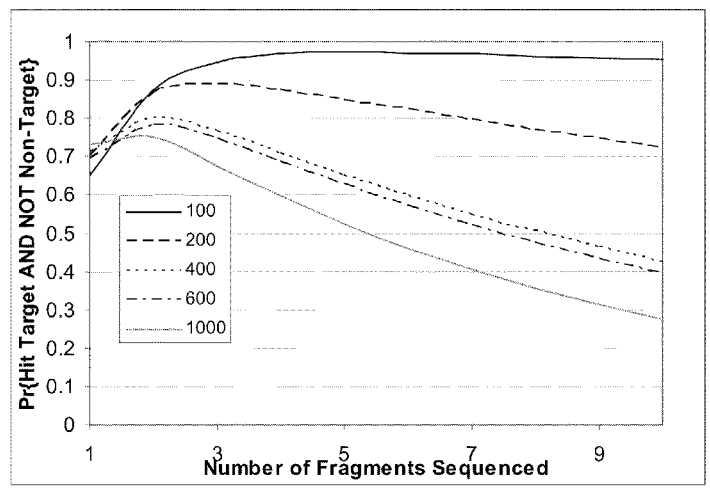
FIG. 22 shows a diagram illustrating the probability that at least one fragment has BLAST hits to the correct family and no fragments have BLAST hits to the incorrect family, calculated as indicated in the text.

The average number of BLAST hits per fragment is another measure of similarity (FIG. 20). The probability that an "unknown" has at least one BLAST hit in the correct family as a function of the number n of fragments sequenced and hits $h_{target}$ is $1-(1-h)^n$, shown in FIG. 21. The probability of at least one BLAST hit in the correct family and no BLAST hits in the incorrect family is $(1-(1-h_{target})^n)(1-h_{non-target})^n$, in FIG. 22. In FIGS. 21 and 22 sequencing several 100 bp fragments is more informative as to correct viral family of an unknown than sequencing a single 1000 bp fragment.

Figure 19:
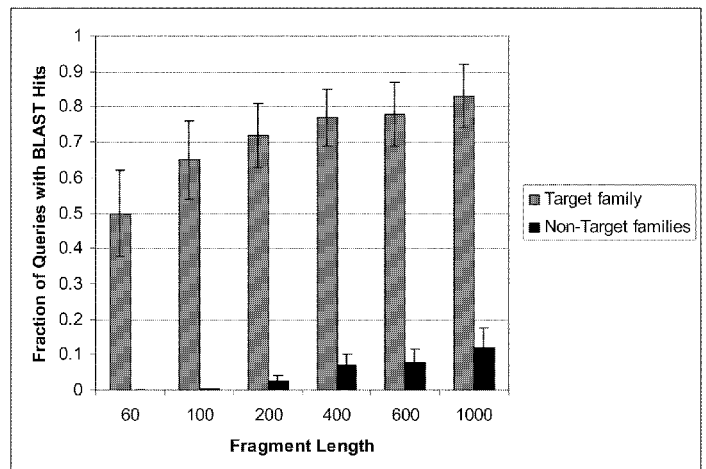
FIG. 19 shows a block diagram illustrating fragments of the lengths indicated, randomly chosen from the genomes of 9 newly emerged virus species and BLASTed against other viruses in the same (target) family or viruses in other (non-target) families are plotted against the fraction of fragments (queries) with BLAST hits.

Another strategy for viral characterization is random rather than specific amplification, followed by sequencing a small number of amplified fragments. Applicants did these simulations, using randomly chosen fragments of a given length instead of fragments amplified by a universal primer set (FIGS. 19 and 20). As with specifically amplified fragments, the chance of sequence similarity to other species in the correct family far exceeds that to viruses in other families. The percentage of specifically amplified fragments with BLAST hits exceeds that for randomly amplified fragments because the conserved primers target areas of higher sequence conservation than randomly selected fragments.

If viral characterization is to be done by sequencing randomly chosen fragments, the question arises of whether it is better to sequence more, shorter fragments or fewer, longer fragments. The fraction of fragments and number of hits per fragment from a newly emerged virus to known viruses increase with fragment length, although the increase shows diminishing returns for lengths over 100 bases. Thus, simulations indicate that 3 fragments of 100 bp would have a higher probability of classifying a virus as to the correct family, since the chance of BLAST hits to target family and not to non-target families is higher for 3 100-mer fragments than for other scenarios (FIGS. 21 and 22).

Example 13

Targeted Amplification with a Conserved 5-6-mer

A third strategy to amplify a limited number of fragments for sequencing from any virus might be to select a single (or few) very short, highly conserved sequence (e.g. 6 bases) with which to prime. Ideally, a single hexamer could be found that should amplify a small number of fragments per genome for every viral genome.

Figure 23:
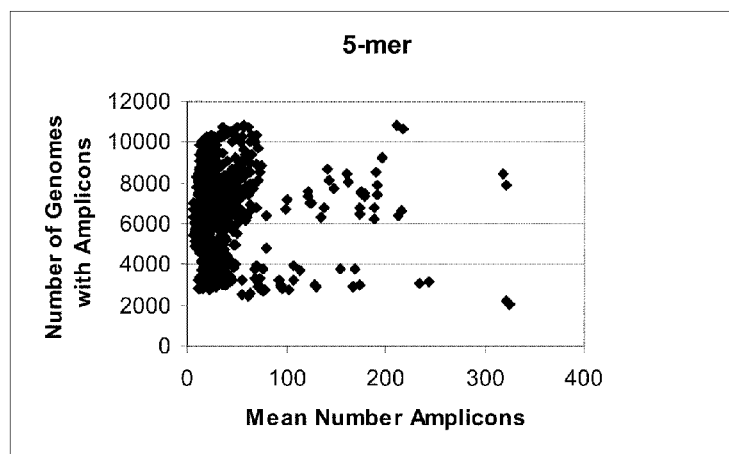
FIG. 23 shows a diagram illustrating viral discovery according to an embodiment herein disclosed performed by amplifying with a single pentamer followed by sequencing the products.
Figure 24:
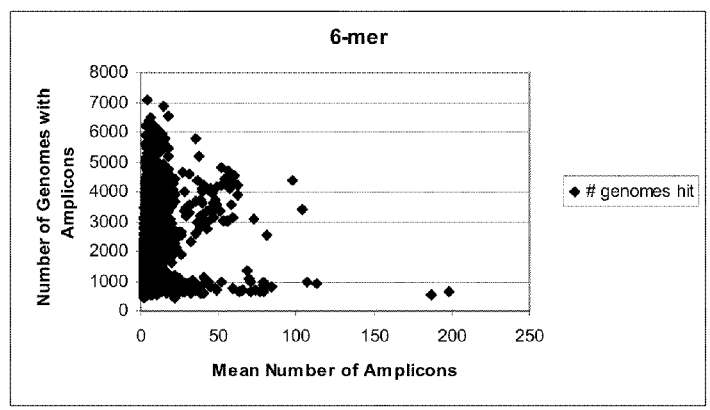
FIG. 24 shows a diagram illustrating viral discovery according to an embodiment herein disclosed performed by amplifying with a single hexamer, followed by sequencing the products.

Applicants enumerated all 4096 hexamers and 1024 pentamers, and calculated all the amplicons that would be produced between length 70-1000 bp if primed by a single penta- or hexamer, for each of the 11,477 viral genomes and segments (including only the MP segment from Orthomyxoviridae and the L segment of Bunyaviridae, as described above). The range of 70-1000 bp limits amplicons to lengths feasible for PCR, electrophoresis, and sequencing. The number of genomes with at least one amplicon was determined, as well as the maximum and mean number of amplicons per genome (with mean calculated based on those with at least one), in order to identify the most promising short oligos to use for universal priming of viral genomes (FIGS. 23 and 24).

The third strategy Applicants investigated using bioinformatics was that of using a single pentamer or hexamer 3' anchor sequence to amplify fragments from the maximum number of viral genomes, and ideally to amplify only a small number of fragments per genome for easy analysis by, for example, length, base composition, or sequence. As indicated in FIGS. 23 and 24, oligos exist that approach this goal (oligos giving points in the upper left corners of the plots), but none are perfect, so that either one risks missing some genomes and/or amplifying so many fragments that it would be difficult to decipher the results. The best sequences are shown in Table 7, and the complete list is available upon request from the Applicants.

| Sequence | SEQ ID NO | # genomes amplified | Mean # amplicons per genome | Max # amplicons per genome |
|---|---|---|---|---|
| AAATG | 11,340 | 10798 | 57 | 3523 |
| CAAGA | 11,341 | 10349 | 24 | 1421 |
| AATCC | 11,342 | 10250 | 20 | 1238 |
| TCAGG | 11,343 | 10065 | 15 | 617 |
| AGACC | 11,344 | 9902 | 13 | 560 |
| CACTT | 11,345 | 9892 | 16 | 1245 |
| TCCATG | 11,346 | 7066 | 5 | 68 |
| CCAAAA | 11,347 | 6477 | 6 | 116 |
| CATGGA | 11,348 | 6356 | 5 | 73 |
| CAAAGC | 11,349 | 6217 | 3 | 57 |
| CACTTG | 11,350 | 5894 | 3 | 123 |
| TCCATG and CAAAGC | 11,346 and 11,349 | 9449 | 8 | 134 |
| All 5 hexamers | 11,346-11,349 | 10703 | 40 | 1275 |

The pentamer AAATG (SEQ ID NO: 11,340) amplifies 10,798 of the 11,477 viral genomes, but the mean and maximum number of amplicons per genome is somewhat high, 57 and 3,523, respectively. Instead, the pentamer AGACC (SEQ ID NO: 11,344), which amplifies 9902 genomes with an average of 13 amplicons per genome and a maximum of 560 amplicons per genome, might enable easier amplicon characterization. The best hexamer amplifies only 7066 genomes, but only produces on average 4.6 bands/genome, and never more than 68. Combining two of the best hexamers, TCCATG (SEQ ID NO: 11,346) and CAAAGC (SEQ ID NO: 11,349) in a single reaction, generates amplicons in 9449 genomes, with an average and maximum of 8 and 134 amplicons per genome, respectively. Combining the 5 hexamers in Table 3 in a single reaction mix would amplify 10,703 genomes, with an average and maximum of 40 and 1275 amplicons per genome, which comes closer to our goal of maximizing genomes with amplicons while minimizing amplicons per genome, than using the single best pentamer.

The genomes that typically give many amplicons are long, for example, from the families Herpesviridae, Poxviridae, and Phycodnaviridae. One might amplify a sample in two separate reactions, one in which a more common penta- or hexamer were used to ensure amplification from all viruses, and the other with a less common oligo that would produce intelligible amplicon distributions even for long genomes. The 5-mer oligos used as 3' anchor sequences by Nanda for viral detection [ref. 17], TTCTG (SEQ ID NO: 11,351) and TGTGG (SEQ ID NO: 11,352), are predicted to amplify 9,051 and 7415 of the total 11,477 viral genomes, respectively. The (mean, maximum) number of amplicons per genome for TTCTG (SEQ ID NO: 11,351) and TGTGG (SEQ ID NO: 11,352) are predicted to be (29, 2847) and (23, 826), respectively.

Example 14

Targeted Amplification with a Conserved 7-mer to 30-mer

Universal primer sets consisting of short (7-30 base pair) nucleic acid strands has been created that can be used to amplify sequences of target viral DNA/RNA. These primer sets were designed to amplify specific nucleic acid sequences of all viral complete genomes sequenced to date, as well primer sets designed separately for various sub-groupings of the viruses, including for each of the vertebrate-infecting viral families. There are currently 28 known virus families that infect vertebrates. Fixing primer size at 10 bases (10-mer), requires between 2 and >700 primers in family-level universal sets (Table 8). The number of primers in a family's set increases with the number of available genomes for that family, as well as the diversity of the family, so Applicants anticipate that as new genomic sequences become available Applicants will need to update the universal primer sets identified so far. The sequences for representative sets of these primers are given in the enclosed Appendix A which makes part of the present specification and is herein incorporated by reference in its entirety.

TABLE 8

| | Family | number of genomes (or segments) | Number of primers, 10-15-mers[1] | Number of primers, 10-mers[2] | Maximum number of amplicons[3] | Mean number of amplicons[4] |
|---|---|---|---|---|---|---|
| 1 | Adenoviridae | 71 | 37 | 34 | 40 | 9.4 |
| 2 | Arenaviridae | 115 | 101 | 72 | 20 | 5.3 |
| 3 | Arteriviridae | 36 | 10 | 10 | 2 | 1.2 |
| 4 | Asfarviridae | 8 | 2 | 3 | 1 | 1.0 |
| 5 | Astroviridae | 14 | 13 | 12 | 4 | 2.1 |
| 6 | Birnaviridae | 12 | 18 | 16 | 2 | 1.2 |
| 7 | Bornaviridae | 9 | 2 | 2 | 1 | 1.0 |
| 8 | Bunyaviridae | 1004 | 144 | 402 | 25 | 5.5 |
| 9 | Caliciviridae | 70 | 53 | 43 | 9 | 2.8 |
| 10 | Circoviridae | 298 | 25 | 20 | 5 | 3.0 |
| 11 | Coronaviridae | 196 | 23 | 26 | 3 | 1.7 |
| 12 | Deltatvirus | 51 | 5 | 2 | 1 | 1.0 |
| 13 | Filoviridae | 54 | 13 | 10 | 3 | 1.3 |
| 14 | Flaviviridae | 503 | 82 | 65 | 13 | 4.2 |
| 15 | Hepadnaviridae | 901 | 15 | 11 | 10 | 5.3 |
| 16 | Herpesviridae | 80 | 47 | 43 | 168 | 22.0 |
| 17 | Iridoviridae | 13 | 16 | 12 | 2 | 1.3 |
| 18 | Orthomyxoviridae | 16480 | | 433+ | 28 | 6.6 |
| 19 | Papillomaviridae | 168 | 144 | 110 | 32 | 5.1 |
| 20 | Paramyxoviridae | 162 | 70 | 61 | 6 | 2.4 |
| 21 | Parvoviridae | 65 | 61 | 57 | 12 | 3.2 |
| 22 | Picornaviridae | 357 | 59 | 53 | 5 | 2.3 |
| 23 | Polyomaviridae | 454 | 28 | 26 | 5 | 2.1 |
| 24 | Poxviridae | 122 | 29 | 32 | 6 | 2.2 |
| 25 | Reoviridae | 852 | 736 | 695+ | 16 | 3.7 |
| 26 | Retroviridae | 1093 | 173 | 97 | 25 | 11.0 |
| 27 | Rhabdoviridae | 41 | 44 | 36 | 27 | 2.5 |
| 28 | Togaviridae | 96 | 31 | 26 | 8 | 3.0 |

[1]Primer sets of 10-15-mers have $45 \leq T_m \leq 50°$ C., hairpin $\Delta G \geq -3$ kcal/mol, primer dimer $\Delta G \geq -5$ kcal/mol, and generate amplicons of length 70-550 bp for all sequences (genomes or segments) in each family.
[2]Primer sets of 10-mers have $40 \leq T_m \leq 65°$ C., hairpin $\Delta G \geq -5$ kcal/mol, primer dimer $\Delta G \geq -7$ kcal/mol, and generate amplicons of length 60-600 bp for all sequences (genomes or segments) in each family.
[3]Maximum number of amplicons produced by the family's universal primer set for any genome from the indicated family, for 10-mer primer set.
[4]Mean number of amplicons produced by the family's universal primer set across genomes from the indicated family, for 10-mer primer set.

Following nucleic acid amplification, the lengths of the resulting amplicon fragments can be determined through separation using gradient electrophoresis. Individual fragments from a given species or strain of virus creates a unique electrophoretic banding signature. Examples of some fragment length distributions are given in Appendices B-D herein incorporated by reference in their entirety. The average number of electrophoretic bands per genome ranges from 1 to 22 across the viral families, while the maximum number of bands per genome ranges from 1 to 168 bands (see Table 8). For those families in which a large number of primers are required in the multiplexed universal set (e.g. Bunyaviridae, Orthomyxoviridae, and Reoviridae) or a large number of bands are produced for some genomes (e.g. Herpesviridae, Adenoviridae), the family may be subdivided to generate several smaller sets of primers, each of which will amplify fewer bands in a given genome. Another approach could be to use the primer set generated for all sequenced viruses taken together (not divided by family), breaking out various subgroups of primer pairs based on predicted multiplex compatibility. For example, multiplexed primers could be grouped so as to avoid undesired primer dimers and to have very similar $T_m$ values.

Figure 25:
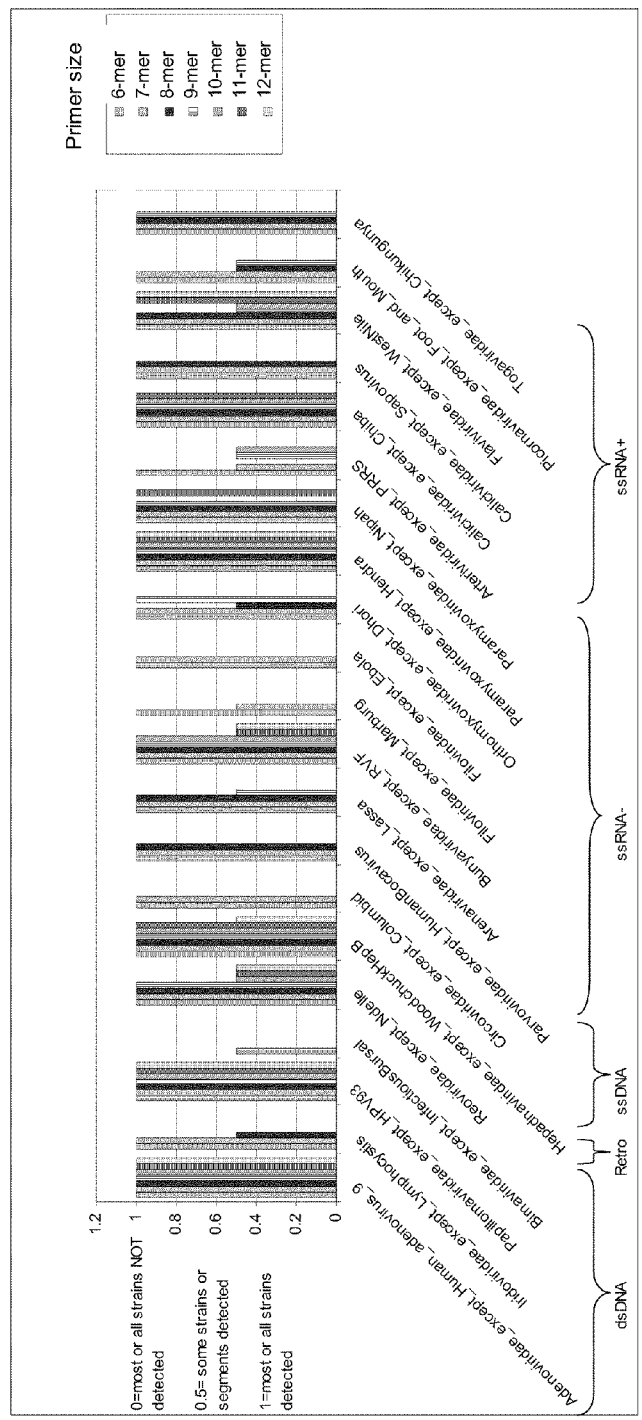
FIG. 25 shows a block diagram illustrating detection/identification of microorganisms using 6-mer to 11-mer primers.
Figure 26:
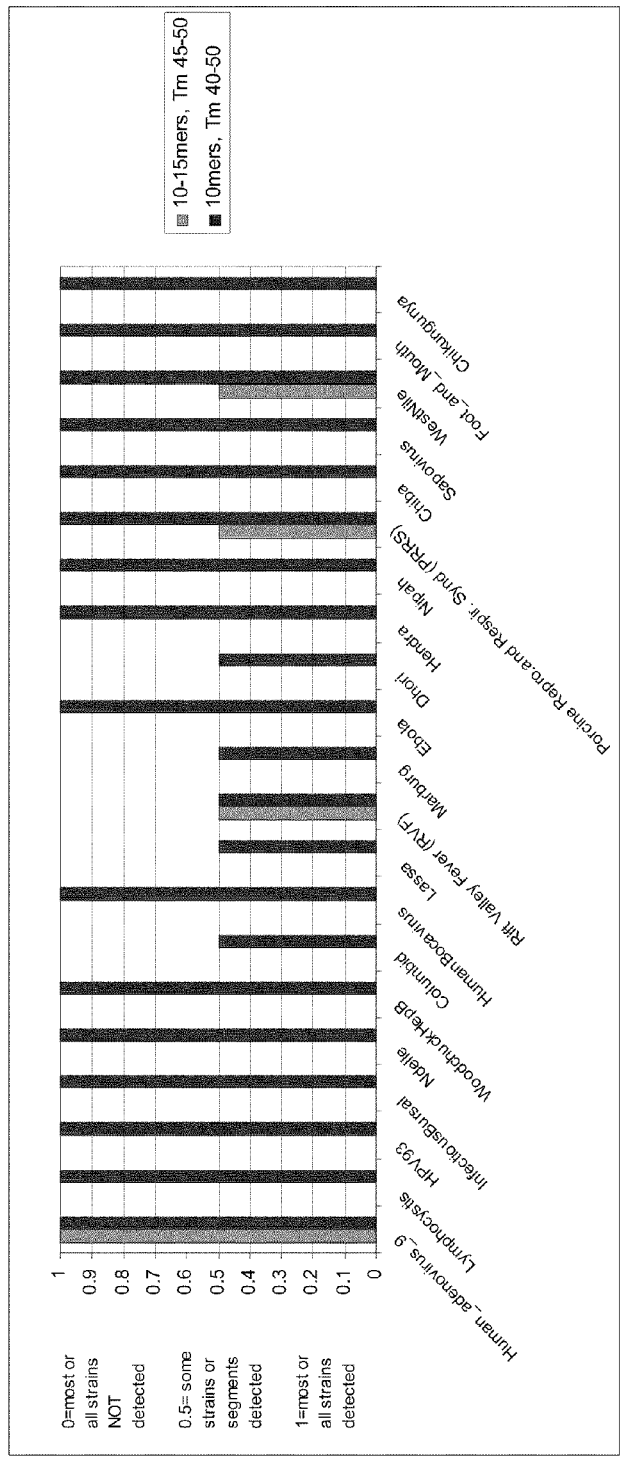
FIG. 26 shows a block diagram illustrating detection/identification of microorganisms using 10-15mers and 10mers primers.

Simulations were performed based on existing sequence data. The results are illustrated in FIGS. 25 and 26. In particular, those simulations indicate that discovery of unknown viruses by observation of new banding patterns in the primer set for the correct family of the previously unknown virus is unlikely for primers longer than 7 bases, since the probability of ≥8-mers being conserved among both known and uncharacterized viruses is less than that of 6-mers or 7-mers being conserved (FIG. 25).

The approach herein described, allows a methodology and application for generating genetic signatures for rapid, species/strain level identification of all viruses and microbes. Universal primer sets consisting of short (7-30 base pairs) nucleic acid strands have been created that can be used to amplify sequences of target viral DNA/RNA. These primer sets were designed to amplify specific nucleic acid sequences in the currently sequenced, vertebrate infecting viruses. Primer sets of the most highly conserved oligos for each family were built such that at least one amplicon would be generated from every full genome currently available in that family. This document describes the algorithm and software built to find such universal primer sets, as well as gives a few examples of universal primer sets that have been predicted. The actual primers generated will depend upon the input specifications desired (e.g. primer length, melting temperature range, amplicon length range, etc.). Amplified fragment length and/or sequence can be further examined using sequencing reactions or electrophoresis in order to characterize the organism. For example, simulations based on SARS as an example organism indicate that sequencing 4 or 5 randomly selected 100-mer fragments should provide very high confidence (>95%) of correctly classifying a novel virus to its correct family. Using the primers in a universal set would be very useful as sequencing primers. Accordingly, the simulations illustrated in FIG. 25 support the conclusions that detection/discovery of unknown viruses in their correct family is unlikely for anything longer than 7-mers.

However, discovery of previously unknown viruses is very likely using 10-mer (or shorter) primer sets from any family (at least one family) that is not necessarily the correct family for the unknown virus (FIG. 26). Using longer than 10-mer primers, e.g. isothermal 10-15-mer primer sets, drastically reduces the chances of discovering unknown viruses, either in the unknown virus' correct family or in any other family. The simulations shown in FIG. 26, indicate that it is not possible to detect all known viruses using 10-mers requiring primer Tm=45-50° C. The acceptable range must be widened to allow primer $T_m$'s as low as 40° C. if Applicants use 10-mers. With variable length, isothermal 10-15-mers with $T_m$=45-50° C., Applicants can detect all the known viruses, but most of the primers are longer than 10 bases. As a consequence, the simulations illustrated in FIG. 26, support the conclusions that detection/discovery of unknown viruses by primers in any family is likely for anything as long as 10-mers, but allowing longer primers drastically reduces the chance of discovery.

In some cases, instead of trying to selectively isolate and identify a given virus from a complex sample, every individual virus would be analyzed in parallel. By dealing with the sample in millions or billions of discrete sub-nanoliter volume reactors, every virus can, in parallel, be individually archived and analyzed. Primers and oligonucleotides determined by the proposed art would be added to the sample before it is divided. Because the microfluidic system is "digital", the sample could be divided into manageable subsets and analyzed using any combination of different oligomer and multiplex size. For example, for practical reasons related to the difficulty in reaction kinetics created by simultaneously amplifying a huge number of different targets, one might divide the sample into bins based on the viral family of interest or the thermodynamics of primer dimer avoidance. Each subsample would then only contain primers specific for a given viral family, limiting the complexity of the amplification reaction. There is also a trade off between using small oligomers, which are likely to hit on any sample (including unknowns), versus using larger oligomers with more specificity. Smaller-mers require a more limited multiplex, but also reduce the fragment resolution since for some viruses the primers in a set may amplify multiple bands, making it difficult to differentiate each fragment size in the distribution.

Software

All the steps of the methods herein described can be implemented as Perl® programs which call other underlying procedures or modules written in Perl® or other programs identifiable by a skilled person. The executable steps according to the methods and algorithms of the present disclosure can be stored on a medium, a computer or on a computer readable medium.

Hardware

All the software programs were developed, tested and installed on a single AMD Opteron 2.4 GHz processor or a Sun Solaris Processor. All programs should also be able to run with minimal modification on any computer that runs PERL.

The examples set forth above are provided to give those of ordinary skill in the art a complete disclosure and description of how to make and use the embodiments of the polynucleotides, systems and methods of the disclosure, and are not intended to limit the scope of what the inventors regard as their disclosure. Modifications of the above-described modes for carrying out the disclosure that are obvious to persons of skill in the art are intended to be within the scope of the following claims. All patents and publications mentioned in the specification are indicative of the levels of skill of those skilled in the art to which the disclosure pertains. All references cited in this disclosure are incorporated by reference to the same extent as if each reference had been incorporated by reference in its entirety individually.

The entire disclosure of each document cited (including patents, patent applications, journal articles, abstracts, laboratory manuals, books, or other disclosures) in the Background, Summary, Detailed Description, and Examples is hereby incorporated herein by reference in its entirety.

Further, each of the source code (a 93 kb txt file created on August 18 herein submitted as Appendix E) and the sequence listing (a 2,230 kb txt file created on Aug. 21, 2008) submitted herewith in computer readable form is incorporated herein by reference in its entirety.

It is to be understood that the disclosures are not limited to particular compositions or biological systems, which can, of course, vary. It is also to be understood that the terminology used herein is for the purpose of describing particular embodiments only, and is not intended to be limiting. As used in this specification and the appended claims, the singular forms "a," "an," and "the" include plural referents unless the content clearly dictates otherwise. The term "plurality" includes two or more referents unless the content clearly dictates otherwise. Unless defined otherwise, all technical and scientific terms used herein have the same meaning as commonly understood by one of ordinary skill in the art to which the disclosure pertains.

Although any methods and materials similar or equivalent to those described herein can be used in the practice for testing of the specific examples of appropriate materials and methods are described herein.

A number of embodiments of the disclosure have been described. Nevertheless, it will be understood that various modifications may be made without departing from the spirit and scope of the present disclosure. Accordingly, other embodiments are within the scope of the following claims.

REFERENCES

1. Afonina, I., I. Ankoudinova, A. Mills, S. Lokhov, and P. Huynh. 2007. Primers with 5' flaps improve real-time PCR. BioTechniques 43:770-774.
2. Brownie, J., S. Shawcross, J. Theaker, D. Whitcombe, R. Ferrie, C. Newton, and S. Little. 1997. The elimination of primer-dimer accumulation in PCR. Nucleic Acids Research 25:3235-3241.
3. DeSantis, T., E. Brodie, J. Moberg, I. Zubieta, Y. Piceno, and G. Andersen. 2007. High-density universal 16S rRNA microarray analysis reveals broader diversity than typical clone library when sampling the environment. Microbial Ecology 53:371-383.
4. Ecker, D., J. Drader, J. Gutierrez, A. Gutierrez, J. Hannis, A. Schink, R. Sampath, and e. al. 2006. The Ibis T5000 universal biosensor: an automated platform for pathogen identification and strain typing. JALA 11:341-51.
5. Edwards, R. A., and F. Rohwer. 2005. Viral metagenomics. Nat Rev Micro 3:504-510.
6. Escutenaire, S., N. Mohamed, M. Isaksson, P. Thoren, B. Klingeborn, S. Belák, M. Berg, and J. Blomberg. 2007. SYBR Green real-time reverse transcription-polymerase chain reaction assay for the generic detection of coronaviruses. Archives of Virology 152:41-58.
7. Gardner, S. N., T. A. Kuczmarski, E. A. Vitalis, and T. R. Slezak. 2003. Limitations of TaqMan PCR for Detecting Divergent Viral Pathogens Illustrated by Hepatitis A, B, C, and E Viruses and Human Immunodeficiency Virus. J. Clin. Microbiol. 41:2417-2427.
8. Griffiths, D., P. Kellam, and R. Weiss. Jul. 6, 2002. Virus detection using degenerate PCR primers. International patent WO/2002/099130.
9. Kistler, A., P. Avila, S. Rouskin, D. Wang, T. Ward, S. Yagi, D. Schnurr, D. Ganem, J. DeRisi, and H. Boushey. 2007. Pan-viral screening of respiratory tract infections in adults with and without asthma reveals unexpected human coronavirus and human rhinovirus diversity. J Infect Dis 196:817-25.
10. Kistler, A., P. Avila, S. Rouskin, D. Wang, T. Ward, S. Yagi, D. Schnurr, D. Ganem, J. DeRisi, and H. Boushey. 2007. Pan-Viral Screening of Respiratory Tract Infections in Adults With and Without Asthma Reveals Unexpected Human Coronavirus and Human Rhinovirus Diversity. The Journal of Infectious Diseases 196:817-825.
11. Lamson, D., N. Renwick, V. Kapoor, Z. Liu, G. Palacios, J. Ju, A. Dean, K. St. George, T. Briese, and W. IanLipkin. 2006. MassTag Polymeraseâ€ Chainâ€ Reaction Detection of Respiratory Pathogens, Including a New Rhinovirus Genotype, That Caused Influenzaâ€ Like Illness in New York State during 2004â€'2005. The Journal of Infectious Diseases 194:1398-1402.
12. Lin, B., K. M. Blaney, A. P. Malanoski, A. G. Ligler, J. M. Schnur, D. Metzgar, K. L. Russell, and D. A. Stenger. 2007. Using a Resequencing Microarray as a Multiple Respiratory Pathogen Detection Assay. J. Clin. Microbiol. 45:443-452.
13. Lin, B., Z. Wang, G. J. Vora, J. A. Thornton, J. M. Schnur, D. C. Thach, K. M. Blaney, A. G. Ligler, A. P. Malanoski, J. Santiago, E. A. Walter, B. K. Agan, D. Metzgar, D. Seto, L. T. Daum, R. Kruzelock, R. K. Rowley, E. H. Hanson, C. Tibbetts, and D. A. Stenger. 2006. Broad-spectrum respiratory tract pathogen identification using resequencing DNA microarrays. Genome Res.: gr.4337206.
14. Mackenzie, J., K. Chua, P. Daniels, B. Eaton, H. Fields, R. Hal, K. Halpin, C. Johansen, P. Kirkland, S. Lam, P. McMinn, D. Nisbet, R. Paru, A. Pyke, S. Ritchie, P. Siba, D. Smith, G. Smith, A. van den Hurk, L. Wang, and D. Williams. 2001. Emerging viral diseases of Southeast Asia and the Western Pacific. Emerging Infectious Diseases 7, supplement: 497-504.
15. Margulies, M., M. Egholm, W. E. Altman, S. Attiya, J. S. Bader, L. A. Bemben, J. Berka, M. S. Braverman, Y.-J. Chen, Z. Chen, S. B. Dewell, L. Du, J. M. Fierro, X. V. Gomes, B. C. Godwin, W. He, S. Helgesen, C. H. Ho, G. P. Irzyk, S. C. Jando, M. L. I. Alenquer, T. P. Jarvie, K. B. Jirage, J.-B. Kim, J. R. Knight, J. R. Lanza, J. H. Leamon, S. M. Lefkowitz, M. Lei, J. Li, K. L. Lohman, H. Lu, V. B. Makhijani, K. E. McDade, M. P. McKenna, E. W. Myers, E. Nickerson, J. R. Nobile, R. Plant, B. P. Puc, M. T. Ronan, G. T. Roth, G. J. Sarkis, J. F. Simons, J. W. Simpson, M. Srinivasan, K. R. Tartaro, A. Tomasz, K. A. Vogt, G. A. Volkmer, S. H. Wang, Y. Wang, M. P. Weiner, P. Yu, R. F. Begley, and J. M. Rothberg. 2005. Genome sequencing in microfabricated high-density picoliter reactors. Nature 437:376-380.
16. Markham, N., and M. Zuker. 2005. DINAMelt web server for nucleic acid melting prediction. Nucleic Acids Research 33:W577-W581.
17. Nanda, S. 2007. Presented at the ASM Biodefense and Emerging Diseases Research Meeting, Washington, D.C.

18. Palacios, G., P. Quan, O. Jabado, S. Conlan, D. Hirschberg, Y. Liu, J. Zhai, N. Renwick, J. Hui, H. Hegyi, A. Grolla, J. Strong, J. Towner, T. Geisbert, P. Jahrling, C. Büchen-Osmond, H. Ellerbrok, M. Sanchez-Seco, Y. Lussier, P. Formenty, M. Nichol, H. Feldmann, T. Briese, and W. Lipkin. 2007. Panmicrobial oligonucleotide array for diagnosis of infectious diseases. Emerg Infect Dis. 13:73-81.
19. Pichon, J.-P., B. Bonnaud, and F. Mallet. 2007. Quantitative multiplex degenerate PCR for human endogenous retrovirus expression profiling. Nat. Protocols 1:2831-2838.
20. Png, A., K. Choo, C. Lee, S. Leong, and O. Kon. 2006. Primer design for whole genome amplification using genetic algorithms. In Silico Biology 6: 1-10.
21. Quan, P.-L., G. Palacios, O. J. Jabado, S. Conlan, D. L. Hirschberg, F. Pozo, P. J. M. Jack, D. Cisterna, N. Renwick, J. Hui, A. Drysdale, R. Amos-Ritchie, E. Baumeister, V. Savy, K. M. Lager, J. A. Richt, D. B. Boyle, A. Garcia-Sastre, I. Casas, P. Perez-Brena, T. Briese, and W. I. Lipkin. 2007. Detection of Respiratory Viruses and Subtype Identification of Influenza A Viruses by GreeneChipResp Oligonucleotide Microarray. J. Clin. Microbiol. 45:2359-2364.
22. Sampath, R., T. A. Hall, C. Massire, F. Li, L. B. Blyn, M. W. Eshoo, S. A. Hofstadler, and D. J. Ecker. 2007. Rapid Identification of Emerging Infectious Agents Using PCR and Electrospray Ionization Mass Spectrometry. Ann. N.Y. Acad. Sci. 1102:109-120.
23. Shuber, A., V. Grondin, and K. Klinger. 1995. A simplified procedure for developing multiplex PCRs. Genome Research 5:488-493.
24. Wang, D., L. Coscoy, M. Zylberberg, P. Avila, H. Boushey, D. Ganem, and J. DeRisi. 2002. Microarray-based detection and genotyping of viral pathogens. PNAS 99.
25. Wang, D., A. Urisman, Y. Liu, M. Springer, T. Ksiazek, and e. al. 2003. Viral Discovery and Sequence Recovery Using DNA Microarrays. PLoS Biology 1:e2 doi: 10.1371/journal.pbio.0000002.
26. Wang, X., L. Zhang, L. Jin, M. Jin, Z. Shen, S. An, F. Chao, and J. Ki. 2007. Development and application of an oligonucleotide microarray for the detection of food-borne bacterial pathogens. Applied Microbiology and Biotechnology 76:225-233.
27. Welzel, T. M., W. J. Miley, T. L. Parks, J. J. Goedert, D. Whitby, and B. A. Ortiz-Conde. 2006. Real-Time PCR Assay for Detection and Quantification of Hepatitis B Virus Genotypes A to G. J. Clin. Microbiol. 44:3325-3333.
28. Woolhouse, M. 2006. Where do emerging pathogens come from? Microbe 1:511-515.
29. Altschul, S. F., T. Madden, A. Schaffer, J. Zhang, Z. Zhang, W. Miller, and D. Lipman. 1997. Gapped BLAST and PSI-BLAST: a new generation of protein database search programs. Nucleic Acids Res. 25:3389-3402.
30. Casabianca, A., C. Gori, C. Orlandi, F. Forbici, C. Federico Perno, and M. Magnani. 2007. Fast and sensitive quantitative detection of HIV DNA in whole blood leucocytes by SYBR green I real-time PCR assay. Molecular and Cellular Probes 21:368-378.
31. Chenna, R., H. Sugawara, T. Koike, R. Lopez, T. J. Gibson, D. G. Higgins, and J. D. Thompson. 2003. Multiple sequence alignment with the Clustal series of programs. Nucl. Acids Res. 31:3497-3500.
32. Eddy, S. R. 1998. Profile hidden Markov models. Bioinformatics 14:755-763.
33. Edgar, R. C. 2004. MUSCLE: multiple sequence alignment with high accuracy and high throughput. Nucl. Acids Res. 32:1792-1797.
34. Gadberry, M. D., S. T. Malcomber, A. N. Doust, and E. A. Kellogg. 2005. Primaclade—a flexible tool to find conserved PCR primers across multiple species. Bioinformatics 21:1263-1264.
35. Huang, Y.-C., C.-F. Chang, C.-h. Chan, T.-J. Yeh, Y.-C. Chang, C.-C. Chen, and C.-Y. Kao. 2005. Integrated minimum-set primers and unique probe design algorithms for differential detection on symptom-related pathogens. Bioinformatics 21:4330-4337.
36. Jabado, O. J., G. Palacios, V. Kapoor, J. Hui, N. Renwick, J. Zhai, T. Briese, and W. I. Lipkin. 2006. Greene SCPrimer: a rapid comprehensive tool for designing degenerate primers from multiple sequence alignments. Nucl. Acids Res. 34:6605-6611.
37. Jarman, S. N. 2004. Amplicon: software for designing PCR primers on aligned DNA sequences. Bioinformatics 20:1644-1645.
38. Linhart, C., and R. Shamir. 2002. The degenerate primer design problem. Bioinformatics 18: S172-181.
39. Markham, N., and M. Zuker. 2005. DINAMelt web server for nucleic acid melting prediction. Nucleic Acids Research 33:W577-W581.
40. Rachlin, J., C. Ding, C. Cantor, and S. Kasif. 2005. MuPlex: multi-objective multiplex PCR assay design. Nucl. Acids Res. 33:W544-W547.
41. Rose, T., J. Henikoff, and S. Henikoff. 2003. CODEHOP (COnsensus-DEgenerate Hybrid Oligonucleotide Primer) PCR primer design. Nucl. Acids Res. 31:3763-3766.

Lengthy table referenced here

US09434997-20160906-T00001

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US09434997B2). An electronic copy of the table will also be available from the USPTO upon request and payment of the fee set forth in 37 CFR 1.19(b)(3).

SEQUENCE LISTING (11358 sequences)

SEQ ID NO: 1 - DNA, 10 bp, Artificial Sequence
  Synthetic Polynucleotide
tgatgcctga

SEQ ID NO: 2 - DNA, 10 bp, Artificial Sequence
  Synthetic Polynucleotide
tggcaacagg

SEQ ID NO: 3 - DNA, 10 bp, Artificial Sequence
  Synthetic Polynucleotide
agcacatcca

SEQ ID NO: 4 - DNA, 10 bp, Artificial Sequence
  Synthetic Polynucleotide
ggaggatggc

SEQ ID NO: 5 - DNA, 10 bp, Artificial Sequence
  Synthetic Polynucleotide
cccagggaga

SEQ ID NO: 6 - DNA, 10 bp, Artificial Sequence
  Synthetic Polynucleotide
ttggagccat

SEQ ID NO: 7 - DNA, 10 bp, Artificial Sequence
  Synthetic Polynucleotide
ctgctcgata

SEQ ID NO: 8 - DNA, 10 bp, Artificial Sequence
  Synthetic Polynucleotide
atgcagcaga

SEQ ID NO: 9 - DNA, 10 bp, Artificial Sequence
  Synthetic Polynucleotide
tattgggcgt

SEQ ID NO: 10 - DNA, 10 bp, Artificial Sequence
  Synthetic Polynucleotide
cctgtgacac

SEQ ID NO: 11 - DNA, 10 bp, Artificial Sequence
  Synthetic Polynucleotide
accgcatgtt

SEQ ID NO: 12 - DNA, 10 bp, Artificial Sequence
  Synthetic Polynucleotide
agcttcgggg

SEQ ID NO: 13 - DNA, 10 bp, Artificial Sequence
  Synthetic Polynucleotide
gcaaggacta

SEQ ID NO: 14 - DNA, 10 bp, Artificial Sequence
  Synthetic Polynucleotide
tgcaacacca

SEQ ID NO: 15 - DNA, 10 bp, Artificial Sequence
  Synthetic Polynucleotide
tggcaaagga

SEQ ID NO: 16 - DNA, 10 bp, Artificial Sequence
  Synthetic Polynucleotide
caggacaagc

SEQ ID NO: 17 - DNA, 10 bp, Artificial Sequence
  Synthetic Polynucleotide
tgacaagccc

SEQ ID NO: 18 - DNA, 10 bp, Artificial Sequence
  Synthetic Polynucleotide
gctggcaagg

SEQ ID NO: 19 - DNA, 10 bp, Artificial Sequence
  Synthetic Polynucleotide
gagcacatcc

SEQ ID NO: 20 - DNA, 10 bp, Artificial Sequence
  Synthetic Polynucleotide
attttggcga

SEQ ID NO: 21 - DNA, 10 bp, Artificial Sequence
  Synthetic Polynucleotide
tggtccagta

SEQ ID NO: 22 - DNA, 10 bp, Artificial Sequence
  Synthetic Polynucleotide
agcctgcaaa

SEQ ID NO: 23 - DNA, 10 bp, Artificial Sequence
  Synthetic Polynucleotide
tgattgccag

SEQ ID NO: 24 - DNA, 10 bp, Artificial Sequence
  Synthetic Polynucleotide
tggcaaggaa

SEQ ID NO: 25 - DNA, 10 bp, Artificial Sequence
  Synthetic Polynucleotide
gccccgaagc

SEQ ID NO: 26 - DNA, 10 bp, Artificial Sequence
  Synthetic Polynucleotide
atggatggga

SEQ ID NO: 27 - DNA, 10 bp, Artificial Sequence
  Synthetic Polynucleotide
tctgcattgc

SEQ ID NO: 28 - DNA, 10 bp, Artificial Sequence
  Synthetic Polynucleotide
attttggcga

SEQ ID NO: 29 - DNA, 10 bp, Artificial Sequence
  Synthetic Polynucleotide
gctccaaaga

SEQ ID NO: 30 - DNA, 10 bp, Artificial Sequence
  Synthetic Polynucleotide
aatgccccaa

SEQ ID NO: 31 - DNA, 10 bp, Artificial Sequence
  Synthetic Polynucleotide
cctgggtagc

SEQ ID NO: 32 - DNA, 10 bp, Artificial Sequence
  Synthetic Polynucleotide
agcaaaagca

SEQ ID NO: 33 - DNA, 10 bp, Artificial Sequence
  Synthetic Polynucleotide
tcgtctctgt

SEQ ID NO: 34 - DNA, 10 bp, Artificial Sequence
  Synthetic Polynucleotide
atgctgagga

SEQ ID NO: 35 - DNA, 10 bp, Artificial Sequence
  Synthetic Polynucleotide
acatggccca

SEQ ID NO: 36 - DNA, 10 bp, Artificial Sequence
  Synthetic Polynucleotide
gaggttggcc

SEQ ID NO: 37 - DNA, 10 bp, Artificial Sequence
  Synthetic Polynucleotide
acaagggtgt

SEQ ID NO: 38 - DNA, 10 bp, Artificial Sequence
  Synthetic Polynucleotide
gctgcattgc

SEQ ID NO: 39 - DNA, 10 bp, Artificial Sequence
  Synthetic Polynucleotide
gcagagtcca

SEQ ID NO: 40 - DNA, 10 bp, Artificial Sequence
  Synthetic Polynucleotide
catgctccca

SEQ ID NO: 41 - DNA, 10 bp, Artificial Sequence
  Synthetic Polynucleotide
ggggcattct

SEQ ID NO: 42 - DNA, 10 bp, Artificial Sequence
  Synthetic Polynucleotide
tctggggtgt

SEQ ID NO: 43 - DNA, 10 bp, Artificial Sequence
  Synthetic Polynucleotide
tgtctgctgc

SEQ ID NO: 44 - DNA, 10 bp, Artificial Sequence
  Synthetic Polynucleotide
tgtttggagc

SEQ ID NO: 45 - DNA, 10 bp, Artificial Sequence
  Synthetic Polynucleotide
tgacaagccc

SEQ ID NO: 46 - DNA, 10 bp, Artificial Sequence
  Synthetic Polynucleotide
aggaacagga

SEQ ID NO: 47 - DNA, 10 bp, Artificial Sequence
  Synthetic Polynucleotide
gcaatcagga

SEQ ID NO: 48 - DNA, 10 bp, Artificial Sequence
  Synthetic Polynucleotide
gctggtttca

SEQ ID NO: 49 - DNA, 10 bp, Artificial Sequence
  Synthetic Polynucleotide
gcccacatga

SEQ ID NO: 50 - DNA, 10 bp, Artificial Sequence
  Synthetic Polynucleotide
tggtacggtt

SEQ ID NO: 51 - DNA, 10 bp, Artificial Sequence
  Synthetic Polynucleotide
cttgcaatgc

SEQ ID NO: 52 - DNA, 10 bp, Artificial Sequence
  Synthetic Polynucleotide
gtttggtgca

SEQ ID NO: 53 - DNA, 10 bp, Artificial Sequence
  Synthetic Polynucleotide
cccgaagcta

SEQ ID NO: 54 - DNA, 10 bp, Artificial Sequence
  Synthetic Polynucleotide
acggatggga

SEQ ID NO: 55 - DNA, 10 bp, Artificial Sequence
  Synthetic Polynucleotide
aggtcccgtt

SEQ ID NO: 56 - DNA, 10 bp, Artificial Sequence
  Synthetic Polynucleotide
ggaggttggt

SEQ ID NO: 57 - DNA, 10 bp, Artificial Sequence
  Synthetic Polynucleotide
gcaacactgc

SEQ ID NO: 58 - DNA, 10 bp, Artificial Sequence
  Synthetic Polynucleotide
gggctctttg

SEQ ID NO: 59 - DNA, 10 bp, Artificial Sequence
  Synthetic Polynucleotide
gtgctaggga

SEQ ID NO: 60 - DNA, 10 bp, Artificial Sequence
  Synthetic Polynucleotide
gcaggggagt

SEQ ID NO: 61 - DNA, 10 bp, Artificial Sequence
  Synthetic Polynucleotide
gggatgcttc

SEQ ID NO: 62 - DNA, 10 bp, Artificial Sequence
  Synthetic Polynucleotide
gggtcagagg

SEQ ID NO: 63 - DNA, 10 bp, Artificial Sequence
  Synthetic Polynucleotide
gaactggcga

SEQ ID NO: 64 - DNA, 10 bp, Artificial Sequence
  Synthetic Polynucleotide
catggagagc

SEQ ID NO: 65 - DNA, 10 bp, Artificial Sequence
  Synthetic Polynucleotide
tgttggcatg

SEQ ID NO: 66 - DNA, 10 bp, Artificial Sequence
  Synthetic Polynucleotide
aaagcagggg

SEQ ID NO: 67 - DNA, 10 bp, Artificial Sequence
  Synthetic Polynucleotide
actccccaga

SEQ ID NO: 68 - DNA, 10 bp, Artificial Sequence
  Synthetic Polynucleotide
gcccacatta

SEQ ID NO: 69 - DNA, 10 bp, Artificial Sequence
  Synthetic Polynucleotide
ggttggtacg

SEQ ID NO: 70 - DNA, 10 bp, Artificial Sequence
  Synthetic Polynucleotide
gcttgcttcc

SEQ ID NO: 71 - DNA, 10 bp, Artificial Sequence
  Synthetic Polynucleotide
aatgcgacct

SEQ ID NO: 72 - DNA, 10 bp, Artificial Sequence
  Synthetic Polynucleotide
gggtggacat

SEQ ID NO: 73 - DNA, 10 bp, Artificial Sequence
  Synthetic Polynucleotide
tcttggaccc

SEQ ID NO: 74 - DNA, 17 bp, Artificial Sequence
  Synthetic Polynucleotide
gcaaatgttgcacctaa

SEQ ID NO: 75 - DNA, 17 bp, Artificial Sequence
  Synthetic Polynucleotide
tggatttcctttgccat

SEQ ID NO: 76 - DNA, 17 bp, Artificial Sequence
  Synthetic Polynucleotide
agccatccagctacact

SEQ ID NO: 77 - DNA, 17 bp, Artificial Sequence
  Synthetic Polynucleotide
ggttaccatgcaaacaa

SEQ ID NO: 78 - DNA, 17 bp, Artificial Sequence
  Synthetic Polynucleotide
cccagggagaccaaaag

SEQ ID NO: 79 - DNA, 17 bp, Artificial Sequence
  Synthetic Polynucleotide
agcacacaaaatgccat

SEQ ID NO: 80 - DNA, 18 bp, Artificial Sequence
  Synthetic Polynucleotide
gctcgataccgtactata

SEQ ID NO: 81 - DNA, 17 bp, Artificial Sequence
  Synthetic Polynucleotide
tggacatacaatgctga

SEQ ID NO: 82 - DNA, 17 bp, Artificial Sequence
  Synthetic Polynucleotide
gccccgaagctaaacca

SEQ ID NO: 83 - DNA, 18 bp, Artificial Sequence
  Synthetic Polynucleotide
gcatcaaaatgcacaagg

SEQ ID NO: 84 - DNA, 17 bp, Artificial Sequence
  Synthetic Polynucleotide
gtgtattgggcgtcttg

SEQ ID NO: 85 - DNA, 17 bp, Artificial Sequence
  Synthetic Polynucleotide
cacacagagcacaatgg

SEQ ID NO: 86 - DNA, 18 bp, Artificial Sequence
  Synthetic Polynucleotide
gagcacatccagaaactg

SEQ ID NO: 87 - DNA, 17 bp, Artificial Sequence
  Synthetic Polynucleotide
cagggatcaggatatgc

SEQ ID NO: 88 - DNA, 18 bp, Artificial Sequence
  Synthetic Polynucleotide
ggcacatcataagggtaa

SEQ ID NO: 89 - DNA, 18 bp, Artificial Sequence
  Synthetic Polynucleotide
tggttcagagttcctcaa

SEQ ID NO: 90 - DNA, 18 bp, Artificial Sequence
  Synthetic Polynucleotide
tccactatgtaagaccat

SEQ ID NO: 91 - DNA, 18 bp, Artificial Sequence
  Synthetic Polynucleotide
ggttgacacaataatgga

SEQ ID NO: 92 - DNA, 18 bp, Artificial Sequence
  Synthetic Polynucleotide
tgtcctctcattttccat

SEQ ID NO: 93 - DNA, 17 bp, Artificial Sequence
  Synthetic Polynucleotide
gaatccactcaaaaggc

SEQ ID NO: 94 - DNA, 18 bp, Artificial Sequence
  Synthetic Polynucleotide
gcaatccttcagaatgag

SEQ ID NO: 95 - DNA, 18 bp, Artificial Sequence
  Synthetic Polynucleotide
tgcattggttatcatgca

SEQ ID NO: 96 - DNA, 18 bp, Artificial Sequence
  Synthetic Polynucleotide
tagaaacaagggtgtttt

SEQ ID NO: 97 - DNA, 17 bp, Artificial Sequence
  Synthetic Polynucleotide
tggtttagcttcggggc

SEQ ID NO: 98 - DNA, 17 bp, Artificial Sequence
  Synthetic Polynucleotide
tgacaagcccacaaaat

SEQ ID NO: 99 - DNA, 17 bp, Artificial Sequence
  Synthetic Polynucleotide
atagagaatggctggca

SEQ ID NO: 100 - DNA, 17 bp, Artificial Sequence
  Synthetic Polynucleotide
cagttgagtagatcgcc

SEQ ID NO: 101 - DNA, 18 bp, Artificial Sequence
  Synthetic Polynucleotide
aacactcaattcacagct

SEQ ID NO: 102 - DNA, 17 bp, Artificial Sequence
  Synthetic Polynucleotide
cccagggagactaacaa

SEQ ID NO: 103 - DNA, 18 bp, Artificial Sequence
  Synthetic Polynucleotide
tgatcagaaaagcacaca

SEQ ID NO: 104 - DNA, 18 bp, Artificial Sequence
  Synthetic Polynucleotide
taaagaaactatcggctg

SEQ ID NO: 105 - DNA, 17 bp, Artificial Sequence
  Synthetic Polynucleotide
gcagtagcaaatggaac

SEQ ID NO: 106 - DNA, 18 bp, Artificial Sequence
  Synthetic Polynucleotide
tagttgagcaagattcaa

SEQ ID NO: 107 - DNA, 18 bp, Artificial Sequence
  Synthetic Polynucleotide
caccaaaggaagagatgt

SEQ ID NO: 108 - DNA, 17 bp, Artificial Sequence
  Synthetic Polynucleotide
gtgtcacaggaacattg

SEQ ID NO: 109 - DNA, 18 bp, Artificial Sequence
  Synthetic Polynucleotide
gataaaatctgcatcggc

SEQ ID NO: 110 - DNA, 18 bp, Artificial Sequence
  Synthetic Polynucleotide
cgctctatgaagacatcc

SEQ ID NO: 111 - DNA, 17 bp, Artificial Sequence
  Synthetic Polynucleotide
tgggacaatggtgaaaa

SEQ ID NO: 112 - DNA, 17 bp, Artificial Sequence
  Synthetic Polynucleotide
ccaacctccttctatga

SEQ ID NO: 113 - DNA, 18 bp, Artificial Sequence
  Synthetic Polynucleotide
catggtatggacacattc

SEQ ID NO: 114 - DNA, 17 bp, Artificial Sequence
  Synthetic Polynucleotide
gccccgaagctaaacca

SEQ ID NO: 115 - DNA, 18 bp, Artificial Sequence
  Synthetic Polynucleotide
atggagagcataaggaac

SEQ ID NO: 116 - DNA, 18 bp, Artificial Sequence
  Synthetic Polynucleotide
cacattccagattgtgtc

SEQ ID NO: 117 - DNA, 17 bp, Artificial Sequence
  Synthetic Polynucleotide
tggtcctacatcgtcga

SEQ ID NO: 118 - DNA, 18 bp, Artificial Sequence
  Synthetic Polynucleotide
taaccataccatccatct

SEQ ID NO: 119 - DNA, 18 bp, Artificial Sequence
  Synthetic Polynucleotide
cacgaagtgtcaaacacc

SEQ ID NO: 120 - DNA, 18 bp, Artificial Sequence
  Synthetic Polynucleotide
gtacaacgaacatttcca

SEQ ID NO: 121 - DNA, 17 bp, Artificial Sequence
  Synthetic Polynucleotide
tacagcagtgttgcctc

SEQ ID NO: 122 - DNA, 18 bp, Artificial Sequence
  Synthetic Polynucleotide
gattgccagtgacaagga

SEQ ID NO: 123 - DNA, 18 bp, Artificial Sequence
  Synthetic Polynucleotide
ggacatataatgccgaac

SEQ ID NO: 124 - DNA, 18 bp, Artificial Sequence
  Synthetic Polynucleotide
tagatttccagttgcttc

SEQ ID NO: 125 - DNA, 18 bp, Artificial Sequence
  Synthetic Polynucleotide
agtctctaccagaatgca

SEQ ID NO: 126 - DNA, 18 bp, Artificial Sequence
  Synthetic Polynucleotide
ccttctatgaatcctgct

SEQ ID NO: 127 - DNA, 18 bp, Artificial Sequence
  Synthetic Polynucleotide
tgggtgctataaattcca

SEQ ID NO: 128 - DNA, 18 bp, Artificial Sequence
  Synthetic Polynucleotide
tctatcattccagtccat

SEQ ID NO: 129 - DNA, 18 bp, Artificial Sequence
  Synthetic Polynucleotide
gatgccacatgccagact

SEQ ID NO: 130 - DNA, 17 bp, Artificial Sequence
  Synthetic Polynucleotide
cactagcgttccgtttg

SEQ ID NO: 131 - DNA, 18 bp, Artificial Sequence
  Synthetic Polynucleotide
cattgctttgagctacat

SEQ ID NO: 132 - DNA, 18 bp, Artificial Sequence
  Synthetic Polynucleotide
tgcatctacaagatccat

SEQ ID NO: 133 - DNA, 18 bp, Artificial Sequence
  Synthetic Polynucleotide
gcatttacagtacagtgg

SEQ ID NO: 134 - DNA, 18 bp, Artificial Sequence
  Synthetic Polynucleotide
acatgatccattactgca

SEQ ID NO: 135 - DNA, 18 bp, Artificial Sequence
  Synthetic Polynucleotide
ctggactgatcaatggat

SEQ ID NO: 136 - DNA, 17 bp, Artificial Sequence
  Synthetic Polynucleotide
attctgtctgcaagcat

SEQ ID NO: 137 - DNA, 17 bp, Artificial Sequence
  Synthetic Polynucleotide
gcagggttcatagaagg

SEQ ID NO: 138 - DNA, 18 bp, Artificial Sequence
  Synthetic Polynucleotide
acatccagaagctgattg

SEQ ID NO: 139 - DNA, 18 bp, Artificial Sequence
  Synthetic Polynucleotide
tcaccatcaaaatgagca

SEQ ID NO: 140 - DNA, 18 bp, Artificial Sequence
  Synthetic Polynucleotide
tgcaatggcaagaagtag

SEQ ID NO: 141 - DNA, 17 bp, Artificial Sequence
  Synthetic Polynucleotide
atggtcctacaatgctg

SEQ ID NO: 142 - DNA, 18 bp, Artificial Sequence
  Synthetic Polynucleotide
tgttgtatgctgtgtcca

SEQ ID NO: 143 - DNA, 18 bp, Artificial Sequence
  Synthetic Polynucleotide
ggaatccctccacttgaa

SEQ ID NO: 144 - DNA, 18 bp, Artificial Sequence
  Synthetic Polynucleotide
ggaatccagtttcactcc

SEQ ID NO: 145 - DNA, 17 bp, Artificial Sequence
  Synthetic Polynucleotide
tgttcgaaacctccatg

SEQ ID NO: 146 - DNA, 18 bp, Artificial Sequence
  Synthetic Polynucleotide
taccaaccatctaccatt

SEQ ID NO: 147 - DNA, 18 bp, Artificial Sequence
  Synthetic Polynucleotide
tgtggtatggcttatcaa

SEQ ID NO: 148 - DNA, 18 bp, Artificial Sequence
  Synthetic Polynucleotide
tacaaatgttgcatctgc

SEQ ID NO: 149 - DNA, 18 bp, Artificial Sequence
  Synthetic Polynucleotide
tcaccatttattcgactg

SEQ ID NO: 150 - DNA, 17 bp, Artificial Sequence
  Synthetic Polynucleotide
agtgtgaagaacggcac

SEQ ID NO: 151 - DNA, 17 bp, Artificial Sequence
  Synthetic Polynucleotide
atggcaaaggaaatcca

SEQ ID NO: 152 - DNA, 18 bp, Artificial Sequence
  Synthetic Polynucleotide
tccatcaaatcgaaaagg

SEQ ID NO: 153 - DNA, 17 bp, Artificial Sequence
  Synthetic Polynucleotide
gcagagtttatgtgggg

SEQ ID NO: 154 - DNA, 18 bp, Artificial Sequence
  Synthetic Polynucleotide
acaactcaacagatacgg

SEQ ID NO: 155 - DNA, 17 bp, Artificial Sequence
  Synthetic Polynucleotide
gtgcatcgcatgtttcc

SEQ ID NO: 156 - DNA, 17 bp, Artificial Sequence
  Synthetic Polynucleotide
tggtttagcttcggggc

SEQ ID NO: 157 - DNA, 17 bp, Artificial Sequence
  Synthetic Polynucleotide
aatgtcctcttggggca

SEQ ID NO: 158 - DNA, 17 bp, Artificial Sequence
  Synthetic Polynucleotide
gacacttgctacccatt

SEQ ID NO: 159 - DNA, 17 bp, Artificial Sequence
  Synthetic Polynucleotide
agcacatccaaagaccc

SEQ ID NO: 160 - DNA, 18 bp, Artificial Sequence
  Synthetic Polynucleotide
gcatcaactcagttaaga

SEQ ID NO: 161 - DNA, 18 bp, Artificial Sequence
  Synthetic Polynucleotide
tgtcactgtcacattctt

SEQ ID NO: 162 - DNA, 18 bp, Artificial Sequence
  Synthetic Polynucleotide
atgcagacacaatatgta

SEQ ID NO: 163 - DNA, 18 bp, Artificial Sequence
  Synthetic Polynucleotide
tacttgattgaattcccc

SEQ ID NO: 164 - DNA, 17 bp, Artificial Sequence
  Synthetic Polynucleotide
gccaaatgcaacacaaa

SEQ ID NO: 165 - DNA, 17 bp, Artificial Sequence
  Synthetic Polynucleotide
gggcagtttcctatagc

SEQ ID NO: 166 - DNA, 17 bp, Artificial Sequence
  Synthetic Polynucleotide
taccagagtctcagaag

SEQ ID NO: 167 - DNA, 17 bp, Artificial Sequence
  Synthetic Polynucleotide
tagatcgccaaaatctg

SEQ ID NO: 168 - DNA, 17 bp, Artificial Sequence
  Synthetic Polynucleotide
tgacgggatcactaaca

SEQ ID NO: 169 - DNA, 18 bp, Artificial Sequence
  Synthetic Polynucleotide
ggcttcactattgtccag

SEQ ID NO: 170 - DNA, 18 bp, Artificial Sequence
  Synthetic Polynucleotide
agagttcatcacagaagg

SEQ ID NO: 171 - DNA, 18 bp, Artificial Sequence
  Synthetic Polynucleotide
cacctcgtatggagtcat

SEQ ID NO: 172 - DNA, 18 bp, Artificial Sequence
  Synthetic Polynucleotide
ggattccaacatcagaac

SEQ ID NO: 173 - DNA, 18 bp, Artificial Sequence
  Synthetic Polynucleotide
attccgcctgattccctg

SEQ ID NO: 174 - DNA, 18 bp, Artificial Sequence
  Synthetic Polynucleotide
atgcagacaaaatttgcc

SEQ ID NO: 175 - DNA, 17 bp, Artificial Sequence
  Synthetic Polynucleotide
cctttgatctggaaccg

SEQ ID NO: 176 - DNA, 18 bp, Artificial Sequence
  Synthetic Polynucleotide
taccagagaaacaaacta

SEQ ID NO: 177 - DNA, 17 bp, Artificial Sequence
  Synthetic Polynucleotide
tcgttttccatgagcac

SEQ ID NO: 178 - DNA, 17 bp, Artificial Sequence
  Synthetic Polynucleotide
catagcaatgagcaggg

SEQ ID NO: 179 - DNA, 18 bp, Artificial Sequence
  Synthetic Polynucleotide
cccatttccaacagagac

SEQ ID NO: 180 - DNA, 18 bp, Artificial Sequence
  Synthetic Polynucleotide
tgaaagagcaccaagacc

SEQ ID NO: 181 - DNA, 18 bp, Artificial Sequence
  Synthetic Polynucleotide
aagagatgaggcgacagt

SEQ ID NO: 182 - DNA, 17 bp, Artificial Sequence
  Synthetic Polynucleotide
gtgaagagggcactggg

SEQ ID NO: 183 - DNA, 18 bp, Artificial Sequence
  Synthetic Polynucleotide
cccacaaaataaaggcta

SEQ ID NO: 184 - DNA, 18 bp, Artificial Sequence
  Synthetic Polynucleotide
agagaatgctgaggacaa

SEQ ID NO: 185 - DNA, 18 bp, Artificial Sequence
  Synthetic Polynucleotide
ccgaagctaaaccataag

SEQ ID NO: 186 - DNA, 17 bp, Artificial Sequence
  Synthetic Polynucleotide
caaaatgcacaaggaga

SEQ ID NO: 187 - DNA, 17 bp, Artificial Sequence
  Synthetic Polynucleotide
tgtcacacttatgccaa

SEQ ID NO: 188 - DNA, 18 bp, Artificial Sequence
  Synthetic Polynucleotide
ccaatcgagaactgtgat

SEQ ID NO: 189 - DNA, 18 bp, Artificial Sequence
  Synthetic Polynucleotide
agagatgaggcgacagtc

SEQ ID NO: 190 - DNA, 17 bp, Artificial Sequence
  Synthetic Polynucleotide
actcaagaagcagttga

SEQ ID NO: 191 - DNA, 18 bp, Artificial Sequence
  Synthetic Polynucleotide
tatagcaccaaataggcc

SEQ ID NO: 192 - DNA, 18 bp, Artificial Sequence
  Synthetic Polynucleotide
gtggagtacaggttgatg

SEQ ID NO: 193 - DNA, 17 bp, Artificial Sequence
  Synthetic Polynucleotide
ccctggatgtagcaatg

SEQ ID NO: 194 - DNA, 17 bp, Artificial Sequence
  Synthetic Polynucleotide
acaacgggaagggatgt

SEQ ID NO: 195 - DNA, 17 bp, Artificial Sequence
  Synthetic Polynucleotide
attccgcatccctgttg

SEQ ID NO: 196 - DNA, 17 bp, Artificial Sequence
  Synthetic Polynucleotide
tgaggtcagatgcacct

SEQ ID NO: 197 - DNA, 18 bp, Artificial Sequence
  Synthetic Polynucleotide
gctagtctctccattggt

SEQ ID NO: 198 - DNA, 18 bp, Artificial Sequence
  Synthetic Polynucleotide
gacatttgttatccaggc

SEQ ID NO: 199 - DNA, 18 bp, Artificial Sequence
  Synthetic Polynucleotide
ggtttggcactttgtgtc

SEQ ID NO: 200 - DNA, 17 bp, Artificial Sequence
  Synthetic Polynucleotide
atggaacatgctacccc

SEQ ID NO: 201 - DNA, 18 bp, Artificial Sequence
  Synthetic Polynucleotide
tattctgcactgtaaaga

SEQ ID NO: 202 - DNA, 17 bp, Artificial Sequence
  Synthetic Polynucleotide
accagattttggcgata

SEQ ID NO: 203 - DNA, 18 bp, Artificial Sequence
  Synthetic Polynucleotide
ggacatttctgagccctg

SEQ ID NO: 204 - DNA, 18 bp, Artificial Sequence
  Synthetic Polynucleotide
gctcctcggtacgctttt

SEQ ID NO: 205 - DNA, 17 bp, Artificial Sequence
  Synthetic Polynucleotide
cattcctcatccctgtt

SEQ ID NO: 206 - DNA, 18 bp, Artificial Sequence
  Synthetic Polynucleotide
cactggcttcacttatgg

SEQ ID NO: 207 - DNA, 18 bp, Artificial Sequence
  Synthetic Polynucleotide
atccataccatccatcaa

SEQ ID NO: 208 - DNA, 18 bp, Artificial Sequence
  Synthetic Polynucleotide
aataaacagccctttgcc

SEQ ID NO: 209 - DNA, 18 bp, Artificial Sequence
  Synthetic Polynucleotide
accattacccatgtcttc

SEQ ID NO: 210 - DNA, 18 bp, Artificial Sequence
  Synthetic Polynucleotide
tccatcagattgaaaagg

SEQ ID NO: 211 - DNA, 18 bp, Artificial Sequence
  Synthetic Polynucleotide
caccctccttctatgaag

SEQ ID NO: 212 - DNA, 18 bp, Artificial Sequence
  Synthetic Polynucleotide
acaccctctcaccattgg

SEQ ID NO: 213 - DNA, 18 bp, Artificial Sequence
  Synthetic Polynucleotide
ttaccccacccattgacg

SEQ ID NO: 214 - DNA, 17 bp, Artificial Sequence
  Synthetic Polynucleotide
tgcttcttgtcttgaca

SEQ ID NO: 215 - DNA, 18 bp, Artificial Sequence
  Synthetic Polynucleotide
gttcagccttgattcttc

SEQ ID NO: 216 - DNA, 18 bp, Artificial Sequence
  Synthetic Polynucleotide
tgttcatccacttaccat

SEQ ID NO: 217 - DNA, 18 bp, Artificial Sequence
  Synthetic Polynucleotide
catttgcccttttgcagg

SEQ ID NO: 218 - DNA, 17 bp, Artificial Sequence
  Synthetic Polynucleotide
gaccacctgaatggggc

SEQ ID NO: 219 - DNA, 18 bp, Artificial Sequence
  Synthetic Polynucleotide
ggcattgtatgtccacac

SEQ ID NO: 220 - DNA, 18 bp, Artificial Sequence
  Synthetic Polynucleotide
tttcgagagcactggtaa

SEQ ID NO: 221 - DNA, 18 bp, Artificial Sequence
  Synthetic Polynucleotide
tattctgcctgattgacc

SEQ ID NO: 222 - DNA, 18 bp, Artificial Sequence
  Synthetic Polynucleotide
gatccatcacccgagtac

SEQ ID NO: 223 - DNA, 18 bp, Artificial Sequence
  Synthetic Polynucleotide
tccacaacagattcctgt

SEQ ID NO: 224 - DNA, 17 bp, Artificial Sequence
  Synthetic Polynucleotide
cgccactggatctaatg

SEQ ID NO: 225 - DNA, 17 bp, Artificial Sequence
  Synthetic Polynucleotide
tgagcatccgacatcat

SEQ ID NO: 226 - DNA, 18 bp, Artificial Sequence
  Synthetic Polynucleotide
gcaagtcatacacaaaca

SEQ ID NO: 227 - DNA, 10 bp, Artificial Sequence
  Synthetic Polynucleotide
tcaaaggccc

SEQ ID NO: 228 - DNA, 10 bp, Artificial Sequence
  Synthetic Polynucleotide
tagcatggtc

SEQ ID NO: 229 - DNA, 10 bp, Artificial Sequence
  Synthetic Polynucleotide
gccaagacca

SEQ ID NO: 230 - DNA, 10 bp, Artificial Sequence
  Synthetic Polynucleotide
tctgggttga

SEQ ID NO: 231 - DNA, 10 bp, Artificial Sequence
  Synthetic Polynucleotide
ccatgagcct

SEQ ID NO: 232 - DNA, 10 bp, Artificial Sequence
  Synthetic Polynucleotide
gtgctcagca

SEQ ID NO: 233 - DNA, 10 bp, Artificial Sequence
  Synthetic Polynucleotide
ccgtctggcc

SEQ ID NO: 234 - DNA, 10 bp, Artificial Sequence
  Synthetic Polynucleotide
ggtgtttgga

SEQ ID NO: 235 - DNA, 10 bp, Artificial Sequence
  Synthetic Polynucleotide
tccctgcata

SEQ ID NO: 236 - DNA, 10 bp, Artificial Sequence
  Synthetic Polynucleotide
caagggagcc

SEQ ID NO: 237 - DNA, 10 bp, Artificial Sequence
  Synthetic Polynucleotide
gtccttccca

SEQ ID NO: 238 - DNA, 10 bp, Artificial Sequence
  Synthetic Polynucleotide
ctgcatgtca

SEQ ID NO: 239 - DNA, 10 bp, Artificial Sequence
  Synthetic Polynucleotide
tttagcccca

SEQ ID NO: 240 - DNA, 10 bp, Artificial Sequence
  Synthetic Polynucleotide
tggtggacca

SEQ ID NO: 241 - DNA, 10 bp, Artificial Sequence
  Synthetic Polynucleotide
gcacttgcat

SEQ ID NO: 242 - DNA, 10 bp, Artificial Sequence
  Synthetic Polynucleotide
taggaacagc

SEQ ID NO: 243 - DNA, 10 bp, Artificial Sequence
  Synthetic Polynucleotide
cccatttgca

SEQ ID NO: 244 - DNA, 10 bp, Artificial Sequence
  Synthetic Polynucleotide
catggcacat

SEQ ID NO: 245 - DNA, 10 bp, Artificial Sequence
  Synthetic Polynucleotide
gtgtccaacc

SEQ ID NO: 246 - DNA, 10 bp, Artificial Sequence
  Synthetic Polynucleotide
ggtcagcaac

SEQ ID NO: 247 - DNA, 10 bp, Artificial Sequence
  Synthetic Polynucleotide
ccatcatggc

SEQ ID NO: 248 - DNA, 10 bp, Artificial Sequence
  Synthetic Polynucleotide
agcaaaagca

SEQ ID NO: 249 - DNA, 10 bp, Artificial Sequence
  Synthetic Polynucleotide
ccatcaggcc

SEQ ID NO: 250 - DNA, 10 bp, Artificial Sequence
  Synthetic Polynucleotide
tgcagagaca

SEQ ID NO: 251 - DNA, 10 bp, Artificial Sequence
  Synthetic Polynucleotide
tgggcttcca

SEQ ID NO: 252 - DNA, 10 bp, Artificial Sequence
  Synthetic Polynucleotide
ggatcagcca

SEQ ID NO: 253 - DNA, 10 bp, Artificial Sequence
  Synthetic Polynucleotide
gtgttcgcat

SEQ ID NO: 254 - DNA, 10 bp, Artificial Sequence
  Synthetic Polynucleotide
gtgcagaaca

SEQ ID NO: 255 - DNA, 10 bp, Artificial Sequence
  Synthetic Polynucleotide
tcctgaccaa

SEQ ID NO: 256 - DNA, 10 bp, Artificial Sequence
  Synthetic Polynucleotide
tgacggatgg

SEQ ID NO: 257 - DNA, 10 bp, Artificial Sequence
  Synthetic Polynucleotide
gaccatgcta

SEQ ID NO: 258 - DNA, 10 bp, Artificial Sequence
  Synthetic Polynucleotide
tccaaggaca

SEQ ID NO: 259 - DNA, 10 bp, Artificial Sequence
  Synthetic Polynucleotide
tcaacccaga

SEQ ID NO: 260 - DNA, 10 bp, Artificial Sequence
  Synthetic Polynucleotide
tggtgtttgg

SEQ ID NO: 261 - DNA, 10 bp, Artificial Sequence
  Synthetic Polynucleotide
gcacttgcat

SEQ ID NO: 262 - DNA, 10 bp, Artificial Sequence
  Synthetic Polynucleotide
tacgattggg

SEQ ID NO: 263 - DNA, 10 bp, Artificial Sequence
  Synthetic Polynucleotide
tctgtgagga

SEQ ID NO: 264 - DNA, 10 bp, Artificial Sequence
  Synthetic Polynucleotide
ggtccagcac

SEQ ID NO: 265 - DNA, 10 bp, Artificial Sequence
  Synthetic Polynucleotide
tctggatgct

SEQ ID NO: 266 - DNA, 10 bp, Artificial Sequence
  Synthetic Polynucleotide
ttccaggagc

SEQ ID NO: 267 - DNA, 10 bp, Artificial Sequence
  Synthetic Polynucleotide
tcctctcctc

SEQ ID NO: 268 - DNA, 10 bp, Artificial Sequence
  Synthetic Polynucleotide
gcagggacaa

SEQ ID NO: 269 - DNA, 10 bp, Artificial Sequence
  Synthetic Polynucleotide
gctggtccat

SEQ ID NO: 270 - DNA, 10 bp, Artificial Sequence
  Synthetic Polynucleotide
gacaatgcga

SEQ ID NO: 271 - DNA, 10 bp, Artificial Sequence
  Synthetic Polynucleotide
ccatcatggc

SEQ ID NO: 272 - DNA, 10 bp, Artificial Sequence
  Synthetic Polynucleotide
ccggcaattc

SEQ ID NO: 273 - DNA, 10 bp, Artificial Sequence
  Synthetic Polynucleotide
tggcatacgc

SEQ ID NO: 274 - DNA, 10 bp, Artificial Sequence
  Synthetic Polynucleotide
tgaatgcagg

SEQ ID NO: 275 - DNA, 10 bp, Artificial Sequence
  Synthetic Polynucleotide
ggcctgttgg

SEQ ID NO: 276 - DNA, 10 bp, Artificial Sequence
  Synthetic Polynucleotide
cgacgggaag

SEQ ID NO: 277 - DNA, 10 bp, Artificial Sequence
  Synthetic Polynucleotide
tcgccccatc

SEQ ID NO: 278 - DNA, 10 bp, Artificial Sequence
  Synthetic Polynucleotide
tggaagggct

SEQ ID NO: 279 - DNA, 17 bp, Artificial Sequence
  Synthetic Polynucleotide
catgagcctgttccata

SEQ ID NO: 280 - DNA, 17 bp, Artificial Sequence
  Synthetic Polynucleotide
agttatgtgtgctcagg

SEQ ID NO: 281 - DNA, 17 bp, Artificial Sequence
  Synthetic Polynucleotide
ccatcattggggcgtgg

SEQ ID NO: 282 - DNA, 17 bp, Artificial Sequence
  Synthetic Polynucleotide
tcctgttatcctgatgc

SEQ ID NO: 283 - DNA, 17 bp, Artificial Sequence
  Synthetic Polynucleotide
ctgctcccactagtcca

SEQ ID NO: 284 - DNA, 18 bp, Artificial Sequence
  Synthetic Polynucleotide
tgagatgatttgggatcc

SEQ ID NO: 285 - DNA, 17 bp, Artificial Sequence
  Synthetic Polynucleotide
ccatgcttttccatcgt

SEQ ID NO: 286 - DNA, 18 bp, Artificial Sequence
  Synthetic Polynucleotide
gaaccttatgtgtcatgc

SEQ ID NO: 287 - DNA, 18 bp, Artificial Sequence
  Synthetic Polynucleotide
gcccaccctttcactcct

SEQ ID NO: 288 - DNA, 17 bp, Artificial Sequence
  Synthetic Polynucleotide
accaaacaagtgtgcat

SEQ ID NO: 289 - DNA, 17 bp, Artificial Sequence
  Synthetic Polynucleotide
tcctatccaaacaccat

SEQ ID NO: 290 - DNA, 17 bp, Artificial Sequence
  Synthetic Polynucleotide
gcttggtcagcaagtgc

SEQ ID NO: 291 - DNA, 17 bp, Artificial Sequence
  Synthetic Polynucleotide
tccaattgtccctacat

SEQ ID NO: 292 - DNA, 18 bp, Artificial Sequence
  Synthetic Polynucleotide
tcacaaggacaatgcaat

SEQ ID NO: 293 - DNA, 17 bp, Artificial Sequence
  Synthetic Polynucleotide
gaccagtcggcaatctc

SEQ ID NO: 294 - DNA, 18 bp, Artificial Sequence
  Synthetic Polynucleotide
ggccatatagaagaatgc

SEQ ID NO: 295 - DNA, 18 bp, Artificial Sequence
  Synthetic Polynucleotide
gccatgagtttacttcac

SEQ ID NO: 296 - DNA, 18 bp, Artificial Sequence
  Synthetic Polynucleotide
tccgtagtaagtctgcta

SEQ ID NO: 297 - DNA, 18 bp, Artificial Sequence
  Synthetic Polynucleotide
ccaccctttcactcctgg

SEQ ID NO: 298 - DNA, 18 bp, Artificial Sequence
  Synthetic Polynucleotide
gtgttccgtttcatttgg

SEQ ID NO: 299 - DNA, 18 bp, Artificial Sequence
  Synthetic Polynucleotide
ggcaactcagcaccgtct

SEQ ID NO: 300 - DNA, 17 bp, Artificial Sequence
  Synthetic Polynucleotide
tggactagtgggagcag

SEQ ID NO: 301 - DNA, 17 bp, Artificial Sequence
  Synthetic Polynucleotide
tgcatttggcaccttta

SEQ ID NO: 302 - DNA, 17 bp, Artificial Sequence
  Synthetic Polynucleotide
gtgttcacagatgggtc

SEQ ID NO: 303 - DNA, 17 bp, Artificial Sequence
  Synthetic Polynucleotide
catgagcctgttccata

SEQ ID NO: 304 - DNA, 17 bp, Artificial Sequence
  Synthetic Polynucleotide
gctcagcatatagagga

SEQ ID NO: 305 - DNA, 17 bp, Artificial Sequence
  Synthetic Polynucleotide
cgatgtcaaagggaaga

SEQ ID NO: 306 - DNA, 18 bp, Artificial Sequence
  Synthetic Polynucleotide
attgaagagtgttcttgc

SEQ ID NO: 307 - DNA, 17 bp, Artificial Sequence
  Synthetic Polynucleotide
tacttgggcataaaccc

SEQ ID NO: 308 - DNA, 18 bp, Artificial Sequence
  Synthetic Polynucleotide
atgatgatgtctcttgga

SEQ ID NO: 309 - DNA, 18 bp, Artificial Sequence
  Synthetic Polynucleotide
gtagatgatttcagcacc

SEQ ID NO: 310 - DNA, 17 bp, Artificial Sequence
  Synthetic Polynucleotide
gactactgggcaaacaa

SEQ ID NO: 311 - DNA, 18 bp, Artificial Sequence
  Synthetic Polynucleotide
ccagaaattccgattgtt

SEQ ID NO: 312 - DNA, 17 bp, Artificial Sequence
  Synthetic Polynucleotide
gttctcacttggaatgc

SEQ ID NO: 313 - DNA, 17 bp, Artificial Sequence
  Synthetic Polynucleotide
gccatgagcctgttcca

SEQ ID NO: 314 - DNA, 17 bp, Artificial Sequence
  Synthetic Polynucleotide
ttctctgttgaaggcaa

SEQ ID NO: 315 - DNA, 17 bp, Artificial Sequence
  Synthetic Polynucleotide
cttggggaatcacatga

SEQ ID NO: 316 - DNA, 17 bp, Artificial Sequence
  Synthetic Polynucleotide
gcagggaaaatgacaga

SEQ ID NO: 317 - DNA, 17 bp, Artificial Sequence
  Synthetic Polynucleotide
gccagcacacaaatatc

SEQ ID NO: 318 - DNA, 17 bp, Artificial Sequence
  Synthetic Polynucleotide
ggatgacagttggagtc

SEQ ID NO: 319 - DNA, 17 bp, Artificial Sequence
  Synthetic Polynucleotide
ctcaccacatctgttgg

SEQ ID NO: 320 - DNA, 18 bp, Artificial Sequence
  Synthetic Polynucleotide
cattaggatcttcaccca

SEQ ID NO: 321 - DNA, 17 bp, Artificial Sequence
  Synthetic Polynucleotide
ttccagttgtctctgca

SEQ ID NO: 322 - DNA, 17 bp, Artificial Sequence
  Synthetic Polynucleotide
ggacaattcaattcggc

SEQ ID NO: 323 - DNA, 17 bp, Artificial Sequence
  Synthetic Polynucleotide
gtattggatttgtgccc

SEQ ID NO: 324 - DNA, 18 bp, Artificial Sequence
  Synthetic Polynucleotide
gcacaataagtcctcgtt

SEQ ID NO: 325 - DNA, 18 bp, Artificial Sequence
  Synthetic Polynucleotide
ttcaaaccctgatcttga

SEQ ID NO: 326 - DNA, 17 bp, Artificial Sequence
  Synthetic Polynucleotide
aatcatcatgcacttgc

SEQ ID NO: 327 - DNA, 17 bp, Artificial Sequence
  Synthetic Polynucleotide
tgcccattacttggtcc

SEQ ID NO: 328 - DNA, 17 bp, Artificial Sequence
  Synthetic Polynucleotide
tgctcccacttggaatg

SEQ ID NO: 329 - DNA, 17 bp, Artificial Sequence
  Synthetic Polynucleotide
ccgctgtaaccagacca

SEQ ID NO: 330 - DNA, 17 bp, Artificial Sequence
  Synthetic Polynucleotide
atgcgaacacaagagtc

SEQ ID NO: 331 - DNA, 18 bp, Artificial Sequence
  Synthetic Polynucleotide
tccttttacgccaggatc

SEQ ID NO: 332 - DNA, 17 bp, Artificial Sequence
  Synthetic Polynucleotide
cagcacttcatgccatg

SEQ ID NO: 333 - DNA, 17 bp, Artificial Sequence
  Synthetic Polynucleotide
taaaccgttgctgtagc

SEQ ID NO: 334 - DNA, 18 bp, Artificial Sequence
  Synthetic Polynucleotide
atatgtatcatgcgaccc

SEQ ID NO: 335 - DNA, 17 bp, Artificial Sequence
  Synthetic Polynucleotide
ccactgtaaccactcca

SEQ ID NO: 336 - DNA, 17 bp, Artificial Sequence
  Synthetic Polynucleotide
cctgtcctcacagacaa

SEQ ID NO: 337 - DNA, 17 bp, Artificial Sequence
  Synthetic Polynucleotide
gaaccgtgccaattatc

SEQ ID NO: 338 - DNA, 18 bp, Artificial Sequence
  Synthetic Polynucleotide
ggtggctgtactaaaata

SEQ ID NO: 339 - DNA, 17 bp, Artificial Sequence
  Synthetic Polynucleotide
ccccttatcaactccac

SEQ ID NO: 340 - DNA, 17 bp, Artificial Sequence
  Synthetic Polynucleotide
gtgtggatgggaagaac

SEQ ID NO: 341 - DNA, 17 bp, Artificial Sequence
  Synthetic Polynucleotide
ggacctcactggaaaca

SEQ ID NO: 342 - DNA, 17 bp, Artificial Sequence
  Synthetic Polynucleotide
tgtgtttgcagggacaa

SEQ ID NO: 343 - DNA, 18 bp, Artificial Sequence
  Synthetic Polynucleotide
cagccattgttttcaatg

SEQ ID NO: 344 - DNA, 17 bp, Artificial Sequence
  Synthetic Polynucleotide
cagaatgatgtgtggct

SEQ ID NO: 345 - DNA, 18 bp, Artificial Sequence
  Synthetic Polynucleotide
gtatcctgaccaatcagt

SEQ ID NO: 346 - DNA, 17 bp, Artificial Sequence
  Synthetic Polynucleotide
gaggaatgctcctgtta

SEQ ID NO: 347 - DNA, 17 bp, Artificial Sequence
  Synthetic Polynucleotide
agactcttgtgttcgca

SEQ ID NO: 348 - DNA, 17 bp, Artificial Sequence
  Synthetic Polynucleotide
tgcagcgatggacccgg

SEQ ID NO: 349 - DNA, 18 bp, Artificial Sequence
  Synthetic Polynucleotide
tactctattttagcccca

SEQ ID NO: 350 - DNA, 18 bp, Artificial Sequence
  Synthetic Polynucleotide
aggacaataagcacagct

SEQ ID NO: 351 - DNA, 18 bp, Artificial Sequence
  Synthetic Polynucleotide
cctccctcgtataagttc

SEQ ID NO: 352 - DNA, 17 bp, Artificial Sequence
  Synthetic Polynucleotide
tcctgttatgtggacac

SEQ ID NO: 353 - DNA, 18 bp, Artificial Sequence
  Synthetic Polynucleotide
gtgccatgagtttacttc

SEQ ID NO: 354 - DNA, 18 bp, Artificial Sequence
  Synthetic Polynucleotide
ggaatgacactatcggta

SEQ ID NO: 355 - DNA, 18 bp, Artificial Sequence
  Synthetic Polynucleotide
catcagggaaagatccag

SEQ ID NO: 356 - DNA, 18 bp, Artificial Sequence
  Synthetic Polynucleotide
cactaaaaggttcagcca

SEQ ID NO: 357 - DNA, 17 bp, Artificial Sequence
  Synthetic Polynucleotide
tcctgaccaatcagtta

SEQ ID NO: 358 - DNA, 18 bp, Artificial Sequence
  Synthetic Polynucleotide
tgaatgcccctaattacc

SEQ ID NO: 359 - DNA, 17 bp, Artificial Sequence
  Synthetic Polynucleotide
gatgcaaacgcattctg

SEQ ID NO: 360 - DNA, 17 bp, Artificial Sequence
  Synthetic Polynucleotide
cgtttcatttgggaacc

SEQ ID NO: 361 - DNA, 17 bp, Artificial Sequence
  Synthetic Polynucleotide
tcccgatccaggttcat

SEQ ID NO: 362 - DNA, 18 bp, Artificial Sequence
  Synthetic Polynucleotide
tcatcaaagtcacagagg

SEQ ID NO: 363 - DNA, 18 bp, Artificial Sequence
  Synthetic Polynucleotide
agggcaattagactgtta

SEQ ID NO: 364 - DNA, 17 bp, Artificial Sequence
  Synthetic Polynucleotide
tcacaagggattagtga

SEQ ID NO: 365 - DNA, 18 bp, Artificial Sequence
  Synthetic Polynucleotide
ctactccacacatcacaa

SEQ ID NO: 366 - DNA, 18 bp, Artificial Sequence
  Synthetic Polynucleotide
aataattgggcaaactga

SEQ ID NO: 367 - DNA, 18 bp, Artificial Sequence
  Synthetic Polynucleotide
gttgattctcatccaagg

SEQ ID NO: 368 - DNA, 18 bp, Artificial Sequence
  Synthetic Polynucleotide
tagtgcagatcacagggt

SEQ ID NO: 369 - DNA, 17 bp, Artificial Sequence
  Synthetic Polynucleotide
ttcaccaataggacagc

SEQ ID NO: 370 - DNA, 17 bp, Artificial Sequence
  Synthetic Polynucleotide
cctgctgaatgacaaac

SEQ ID NO: 371 - DNA, 18 bp, Artificial Sequence
  Synthetic Polynucleotide
tgagcattcttcaatgtg

SEQ ID NO: 372 - DNA, 17 bp, Artificial Sequence
  Synthetic Polynucleotide
tgctctaagtcaaggca

SEQ ID NO: 373 - DNA, 17 bp, Artificial Sequence
  Synthetic Polynucleotide
ttcatcaaaagggtccg

SEQ ID NO: 374 - DNA, 17 bp, Artificial Sequence
  Synthetic Polynucleotide
tcaaagccgcagtgtca

SEQ ID NO: 375 - DNA, 18 bp, Artificial Sequence
  Synthetic Polynucleotide
ccacaaaacacaacaata

SEQ ID NO: 376 - DNA, 18 bp, Artificial Sequence
  Synthetic Polynucleotide
ggcaagtcatagttgaca

SEQ ID NO: 377 - DNA, 17 bp, Artificial Sequence
  Synthetic Polynucleotide
cttgtactcgaccaccc

SEQ ID NO: 378 - DNA, 18 bp, Artificial Sequence
  Synthetic Polynucleotide
ggggtcaaacaagagaac

SEQ ID NO: 379 - DNA, 17 bp, Artificial Sequence
  Synthetic Polynucleotide
tcgatgtcaaagggaag

SEQ ID NO: 380 - DNA, 17 bp, Artificial Sequence
  Synthetic Polynucleotide
gtagctccacggtattt

SEQ ID NO: 381 - DNA, 17 bp, Artificial Sequence
  Synthetic Polynucleotide
ggtcattaggccgactt

SEQ ID NO: 382 - DNA, 18 bp, Artificial Sequence
  Synthetic Polynucleotide
ataagttgggaaatgggg

SEQ ID NO: 383 - DNA, 18 bp, Artificial Sequence
  Synthetic Polynucleotide
ctcaaaaccactcctgga

SEQ ID NO: 384 - DNA, 18 bp, Artificial Sequence
  Synthetic Polynucleotide
catttgtgtgcagggaaa

SEQ ID NO: 385 - DNA, 18 bp, Artificial Sequence
  Synthetic Polynucleotide
ggttttctccttaggctg

SEQ ID NO: 386 - DNA, 18 bp, Artificial Sequence
  Synthetic Polynucleotide
tgaagagtgttcctgtta

SEQ ID NO: 387 - DNA, 17 bp, Artificial Sequence
  Synthetic Polynucleotide
aatcctcgctgatcgtt

SEQ ID NO: 388 - DNA, 18 bp, Artificial Sequence
  Synthetic Polynucleotide
acaaggcaagtgtgtata

SEQ ID NO: 389 - DNA, 17 bp, Artificial Sequence
  Synthetic Polynucleotide
gccagtctcagagcatt

SEQ ID NO: 390 - DNA, 18 bp, Artificial Sequence
  Synthetic Polynucleotide
tggtaaagttgaggacaa

SEQ ID NO: 391 - DNA, 17 bp, Artificial Sequence
  Synthetic Polynucleotide
cttttggttctcccgat

SEQ ID NO: 392 - DNA, 17 bp, Artificial Sequence
  Synthetic Polynucleotide
gcagggataattggcat

SEQ ID NO: 393 - DNA, 17 bp, Artificial Sequence
  Synthetic Polynucleotide
tttgctttctcctccat

SEQ ID NO: 394 - DNA, 18 bp, Artificial Sequence
  Synthetic Polynucleotide
attgcagtactcatagga

SEQ ID NO: 395 - DNA, 18 bp, Artificial Sequence
  Synthetic Polynucleotide
ggttcgactaattgttcg

SEQ ID NO: 396 - DNA, 18 bp, Artificial Sequence
  Synthetic Polynucleotide
gtcgttaattcctgggta

SEQ ID NO: 397 - DNA, 17 bp, Artificial Sequence
  Synthetic Polynucleotide
tgtcatgtatggtccca

SEQ ID NO: 398 - DNA, 18 bp, Artificial Sequence
  Synthetic Polynucleotide
tactagtcacaagggaac

SEQ ID NO: 399 - DNA, 10 bp, Artificial Sequence
  Synthetic Polynucleotide
ctgccatctg

SEQ ID NO: 400 - DNA, 10 bp, Artificial Sequence
  Synthetic Polynucleotide
ggggattggg

SEQ ID NO: 401 - DNA, 10 bp, Artificial Sequence
  Synthetic Polynucleotide
tgcttgccca

SEQ ID NO: 402 - DNA, 10 bp, Artificial Sequence
  Synthetic Polynucleotide
gcgagagcgt

SEQ ID NO: 403 - DNA, 10 bp, Artificial Sequence
  Synthetic Polynucleotide
ggcttgccaa

SEQ ID NO: 404 - DNA, 10 bp, Artificial Sequence
  Synthetic Polynucleotide
tggggtatga

SEQ ID NO: 405 - DNA, 16 bp, Artificial Sequence
  Synthetic Polynucleotide
tgccatctgtttccat

SEQ ID NO: 406 - DNA, 17 bp, Artificial Sequence
  Synthetic Polynucleotide
tggaaaggtgaaggggc

SEQ ID NO: 407 - DNA, 17 bp, Artificial Sequence
  Synthetic Polynucleotide
tagcctccgctagtcaa

SEQ ID NO: 408 - DNA, 17 bp, Artificial Sequence
  Synthetic Polynucleotide
acgcaggactcggcttg

SEQ ID NO: 409 - DNA, 17 bp, Artificial Sequence
  Synthetic Polynucleotide
tgctgttgcactatacc

SEQ ID NO: 410 - DNA, 17 bp, Artificial Sequence
  Synthetic Polynucleotide
gcagcaggaagcactat

SEQ ID NO: 411 - DNA, 17 bp, Artificial Sequence
  Synthetic Polynucleotide
agaggggttgatatccc

SEQ ID NO: 412 - DNA, 18 bp, Artificial Sequence
  Synthetic Polynucleotide
aggtagcactatgggcgc

SEQ ID NO: 413 - DNA, 18 bp, Artificial Sequence
  Synthetic Polynucleotide
ttgtatggattttcaggc

SEQ ID NO: 414 - DNA, 17 bp, Artificial Sequence
  Synthetic Polynucleotide
ttcttcagagcagacca

SEQ ID NO: 415 - DNA, 17 bp, Artificial Sequence
  Synthetic Polynucleotide
ggagctgtttaatgccc

SEQ ID NO: 416 - DNA, 17 bp, Artificial Sequence
  Synthetic Polynucleotide
aacgctgacggtacagg

SEQ ID NO: 417 - DNA, 17 bp, Artificial Sequence
  Synthetic Polynucleotide
cagatcctccttgagcc

SEQ ID NO: 418 - DNA, 18 bp, Artificial Sequence
  Synthetic Polynucleotide
caggagcagaaactttct

SEQ ID NO: 419 - DNA, 18 bp, Artificial Sequence
  Synthetic Polynucleotide
gggtaattttgacctgtc

SEQ ID NO: 420 - DNA, 18 bp, Artificial Sequence
  Synthetic Polynucleotide
ggaagaaaacctccgacg

SEQ ID NO: 421 - DNA, 10 bp, Artificial Sequence
  Synthetic Polynucleotide
cgttcaccca

SEQ ID NO: 422 - DNA, 10 bp, Artificial Sequence
  Synthetic Polynucleotide
acgccgtggg

SEQ ID NO: 423 - DNA, 10 bp, Artificial Sequence
  Synthetic Polynucleotide
atgcggtctt

SEQ ID NO: 424 - DNA, 10 bp, Artificial Sequence
  Synthetic Polynucleotide
gaacacgctg

SEQ ID NO: 425 - DNA, 17 bp, Artificial Sequence
  Synthetic Polynucleotide
cgcaggtaaagtgatct

SEQ ID NO: 426 - DNA, 17 bp, Artificial Sequence
  Synthetic Polynucleotide
ctctcctttgcacgccg

SEQ ID NO: 427 - DNA, 17 bp, Artificial Sequence
  Synthetic Polynucleotide
ttcaggcatagaagctt

SEQ ID NO: 428 - DNA, 17 bp, Artificial Sequence
  Synthetic Polynucleotide
aggatgcccttcaggta

SEQ ID NO: 429 - DNA, 18 bp, Artificial Sequence
  Synthetic Polynucleotide
cacgtactttctccatcg

SEQ ID NO: 430 - DNA, 18 bp, Artificial Sequence
  Synthetic Polynucleotide
gtcatcttctccaaacac

SEQ ID NO: 431 - DNA, 10 bp, Artificial Sequence
  Synthetic Polynucleotide
aatccagggg

SEQ ID NO: 432 - DNA, 10 bp, Artificial Sequence
  Synthetic Polynucleotide
ggagggcgat

SEQ ID NO: 433 - DNA, 10 bp, Artificial Sequence
  Synthetic Polynucleotide
acgaggccgg

SEQ ID NO: 434 - DNA, 10 bp, Artificial Sequence
  Synthetic Polynucleotide
ccttagacgc

SEQ ID NO: 435 - DNA, 10 bp, Artificial Sequence
  Synthetic Polynucleotide
atgttccgct

SEQ ID NO: 436 - DNA, 10 bp, Artificial Sequence
  Synthetic Polynucleotide
acgaggaagt

SEQ ID NO: 437 - DNA, 10 bp, Artificial Sequence
  Synthetic Polynucleotide
tgtgggacga

SEQ ID NO: 438 - DNA, 17 bp, Artificial Sequence
  Synthetic Polynucleotide
tccgtcacttgaagatt

SEQ ID NO: 439 - DNA, 17 bp, Artificial Sequence
  Synthetic Polynucleotide
tgaatgaagatggcgtc

SEQ ID NO: 440 - DNA, 17 bp, Artificial Sequence
  Synthetic Polynucleotide
tatggagcagacagtgc

SEQ ID NO: 441 - DNA, 18 bp, Artificial Sequence
  Synthetic Polynucleotide
ttctgtgaagaggaagag

SEQ ID NO: 442 - DNA, 18 bp, Artificial Sequence
  Synthetic Polynucleotide
taatccagggatcaatta

SEQ ID NO: 443 - DNA, 17 bp, Artificial Sequence
  Synthetic Polynucleotide
aagatggcgtcgaatga

SEQ ID NO: 444 - DNA, 18 bp, Artificial Sequence
  Synthetic Polynucleotide
agtcctaacatcagcaat

SEQ ID NO: 445 - DNA, 18 bp, Artificial Sequence
  Synthetic Polynucleotide
gtaaatgatgatggcgtc

SEQ ID NO: 446 - DNA, 18 bp, Artificial Sequence
  Synthetic Polynucleotide
tcaacaggttctggggcg

SEQ ID NO: 447 - DNA, 18 bp, Artificial Sequence
  Synthetic Polynucleotide
gtataatggatggaccgg

SEQ ID NO: 448 - DNA, 18 bp, Artificial Sequence
  Synthetic Polynucleotide
cttggtgtagcgtcctta

SEQ ID NO: 449 - DNA, 17 bp, Artificial Sequence
  Synthetic Polynucleotide
agagtatggtcttcggc

SEQ ID NO: 450 - DNA, 18 bp, Artificial Sequence
  Synthetic Polynucleotide
tctagcaaaatctcacct

SEQ ID NO: 451 - DNA, 18 bp, Artificial Sequence
  Synthetic Polynucleotide
tgtgaatgaagatggcgt

SEQ ID NO: 452 - DNA, 18 bp, Artificial Sequence
  Synthetic Polynucleotide
ttcacaaaactgggagcc

SEQ ID NO: 453 - DNA, 17 bp, Artificial Sequence
  Synthetic Polynucleotide
atggacttttacgtgcc

SEQ ID NO: 454 - DNA, 17 bp, Artificial Sequence
  Synthetic Polynucleotide
tttgcgaatagaggcaa

SEQ ID NO: 455 - DNA, 17 bp, Artificial Sequence
  Synthetic Polynucleotide
ccagctcagccaaaaca

SEQ ID NO: 456 - DNA, 18 bp, Artificial Sequence
  Synthetic Polynucleotide
agctatggggaaatcaga

SEQ ID NO: 457 - DNA, 18 bp, Artificial Sequence
  Synthetic Polynucleotide
tcaaattctagggttccc

SEQ ID NO: 458 - DNA, 17 bp, Artificial Sequence
  Synthetic Polynucleotide
cactgcaaagacccatt

SEQ ID NO: 459 - DNA, 17 bp, Artificial Sequence
  Synthetic Polynucleotide
agcacacaaaatgccat

SEQ ID NO: 460 - DNA, 17 bp, Artificial Sequence
  Synthetic Polynucleotide
tctgcattctggtagag

SEQ ID NO: 461 - DNA, 18 bp, Artificial Sequence
  Synthetic Polynucleotide
tgttacccaggagatttc

SEQ ID NO: 462 - DNA, 17 bp, Artificial Sequence
  Synthetic Polynucleotide
tgcaatgacccattaga

SEQ ID NO: 463 - DNA, 17 bp, Artificial Sequence
  Synthetic Polynucleotide
tccacagtcgccagttc

SEQ ID NO: 464 - DNA, 18 bp, Artificial Sequence
  Synthetic Polynucleotide
tcctttcattttccagta

SEQ ID NO: 465 - DNA, 18 bp, Artificial Sequence
  Synthetic Polynucleotide
ggttacaggactaaggaa

SEQ ID NO: 466 - DNA, 17 bp, Artificial Sequence
  Synthetic Polynucleotide
ccaaacagacctctaga

SEQ ID NO: 467 - DNA, 17 bp, Artificial Sequence
  Synthetic Polynucleotide
catgcccttatgctgga

SEQ ID NO: 468 - DNA, 18 bp, Artificial Sequence
  Synthetic Polynucleotide
gcagagtttcccattatg

SEQ ID NO: 469 - DNA, 18 bp, Artificial Sequence
  Synthetic Polynucleotide
ctgtactgaaagctgaca

SEQ ID NO: 470 - DNA, 18 bp, Artificial Sequence
  Synthetic Polynucleotide
acccattagaacacatcc

SEQ ID NO: 471 - DNA, 18 bp, Artificial Sequence
  Synthetic Polynucleotide
tagatggatggtatggtt

SEQ ID NO: 472 - DNA, 18 bp, Artificial Sequence
  Synthetic Polynucleotide
ggacattctccaattgtg

SEQ ID NO: 473 - DNA, 17 bp, Artificial Sequence
  Synthetic Polynucleotide
gttcatggcccaatcat

SEQ ID NO: 474 - DNA, 17 bp, Artificial Sequence
  Synthetic Polynucleotide
aagcacttctttccctt

SEQ ID NO: 475 - DNA, 18 bp, Artificial Sequence
  Synthetic Polynucleotide
ctgcactgaaagctgaca

SEQ ID NO: 476 - DNA, 17 bp, Artificial Sequence
  Synthetic Polynucleotide
tgttagtgatcccgtca

SEQ ID NO: 477 - DNA, 18 bp, Artificial Sequence
  Synthetic Polynucleotide
tactgaccaacaaagtct

SEQ ID NO: 478 - DNA, 18 bp, Artificial Sequence
  Synthetic Polynucleotide
catccagaaactgattgc

SEQ ID NO: 479 - DNA, 18 bp, Artificial Sequence
  Synthetic Polynucleotide
gcgtgaagaacggcacat

SEQ ID NO: 480 - DNA, 18 bp, Artificial Sequence
  Synthetic Polynucleotide
cattctccctgcttggtc

SEQ ID NO: 481 - DNA, 18 bp, Artificial Sequence
  Synthetic Polynucleotide
gactcgaacagaggtgtg

SEQ ID NO: 482 - DNA, 17 bp, Artificial Sequence
  Synthetic Polynucleotide
tcatgattgccagtgac

SEQ ID NO: 483 - DNA, 17 bp, Artificial Sequence
  Synthetic Polynucleotide
tatgcagcagacaaaga

SEQ ID NO: 484 - DNA, 18 bp, Artificial Sequence
  Synthetic Polynucleotide
caaccattccttgccatc

SEQ ID NO: 485 - DNA, 18 bp, Artificial Sequence
  Synthetic Polynucleotide
tcattcttcaggaacatg

SEQ ID NO: 486 - DNA, 18 bp, Artificial Sequence
  Synthetic Polynucleotide
ccagaaagaaatcccagc

SEQ ID NO: 487 - DNA, 18 bp, Artificial Sequence
  Synthetic Polynucleotide
ggacatataatgccgaac

SEQ ID NO: 488 - DNA, 18 bp, Artificial Sequence
  Synthetic Polynucleotide
tattgccccaaacaatcc

SEQ ID NO: 489 - DNA, 18 bp, Artificial Sequence
  Synthetic Polynucleotide
ccgattgccaaaggatca

SEQ ID NO: 490 - DNA, 17 bp, Artificial Sequence
  Synthetic Polynucleotide
gcaaatgttgcacctaa

SEQ ID NO: 491 - DNA, 17 bp, Artificial Sequence
  Synthetic Polynucleotide
tggatttcctttgccat

SEQ ID NO: 492 - DNA, 17 bp, Artificial Sequence
  Synthetic Polynucleotide
tcctcagcattttccct

SEQ ID NO: 493 - DNA, 17 bp, Artificial Sequence
  Synthetic Polynucleotide
tggtacggtttcaggca

SEQ ID NO: 494 - DNA, 18 bp, Artificial Sequence
  Synthetic Polynucleotide
ccaattcagtcggctaaa

SEQ ID NO: 495 - DNA, 18 bp, Artificial Sequence
  Synthetic Polynucleotide
accatgcagtagcaaatg

SEQ ID NO: 496 - DNA, 18 bp, Artificial Sequence
  Synthetic Polynucleotide
gttgcacttaatgttgcc

SEQ ID NO: 497 - DNA, 17 bp, Artificial Sequence
  Synthetic Polynucleotide
cgcatccctgttgccaa

SEQ ID NO: 498 - DNA, 18 bp, Artificial Sequence
  Synthetic Polynucleotide
tatgttcaagcatcaggg

SEQ ID NO: 499 - DNA, 18 bp, Artificial Sequence
  Synthetic Polynucleotide
tgttgcatattttccctg

SEQ ID NO: 500 - DNA, 18 bp, Artificial Sequence
  Synthetic Polynucleotide
gggacaatagtgaagaca

SEQ ID NO: 501 - DNA, 18 bp, Artificial Sequence
  Synthetic Polynucleotide
ccttttcgatttgatgga

SEQ ID NO: 502 - DNA, 18 bp, Artificial Sequence
  Synthetic Polynucleotide
gtcacagtctctaccagg

SEQ ID NO: 503 - DNA, 17 bp, Artificial Sequence
  Synthetic Polynucleotide
caggcccacataatgaa

SEQ ID NO: 504 - DNA, 17 bp, Artificial Sequence
  Synthetic Polynucleotide
gagttctcagaagtgga

SEQ ID NO: 505 - DNA, 17 bp, Artificial Sequence
  Synthetic Polynucleotide
agccatccagctacact

SEQ ID NO: 506 - DNA, 17 bp, Artificial Sequence
  Synthetic Polynucleotide
ggttaccatgcaaacaa

SEQ ID NO: 507 - DNA, 17 bp, Artificial Sequence
  Synthetic Polynucleotide
catgattgccagtgcta

SEQ ID NO: 508 - DNA, 17 bp, Artificial Sequence
  Synthetic Polynucleotide
catagcaatgagcaggg

SEQ ID NO: 509 - DNA, 17 bp, Artificial Sequence
  Synthetic Polynucleotide
tagaactcgaaacaacc

SEQ ID NO: 510 - DNA, 18 bp, Artificial Sequence
  Synthetic Polynucleotide
tgaacttctggttctcat

SEQ ID NO: 511 - DNA, 18 bp, Artificial Sequence
  Synthetic Polynucleotide
gcttcgaattgagtgttc

SEQ ID NO: 512 - DNA, 18 bp, Artificial Sequence
  Synthetic Polynucleotide
ggattcatagaaggagga

SEQ ID NO: 513 - DNA, 18 bp, Artificial Sequence
  Synthetic Polynucleotide
gttcagtgttgatgttcc

SEQ ID NO: 514 - DNA, 18 bp, Artificial Sequence
  Synthetic Polynucleotide
tacccaacaataaagagg

SEQ ID NO: 515 - DNA, 17 bp, Artificial Sequence
  Synthetic Polynucleotide
gctagggaactcgccac

SEQ ID NO: 516 - DNA, 17 bp, Artificial Sequence
  Synthetic Polynucleotide
cagggaagtggatatgc

SEQ ID NO: 517 - DNA, 17 bp, Artificial Sequence
  Synthetic Polynucleotide
ccgttgtgtgtcttttc

SEQ ID NO: 518 - DNA, 18 bp, Artificial Sequence
  Synthetic Polynucleotide
tgcaatagtcagtcttgt

SEQ ID NO: 519 - DNA, 18 bp, Artificial Sequence
  Synthetic Polynucleotide
gttcagccttgattcttc

SEQ ID NO: 520 - DNA, 17 bp, Artificial Sequence
  Synthetic Polynucleotide
agaacttctggtgctta

SEQ ID NO: 521 - DNA, 17 bp, Artificial Sequence
  Synthetic Polynucleotide
tgcaccgcatgtttcca

SEQ ID NO: 522 - DNA, 17 bp, Artificial Sequence
  Synthetic Polynucleotide
tggtttagcttcggggc

SEQ ID NO: 523 - DNA, 18 bp, Artificial Sequence
  Synthetic Polynucleotide
cattgcttcttctctgta

SEQ ID NO: 524 - DNA, 17 bp, Artificial Sequence
  Synthetic Polynucleotide
tggaccagagactccat

SEQ ID NO: 525 - DNA, 18 bp, Artificial Sequence
  Synthetic Polynucleotide
tctgtggcattcactact

SEQ ID NO: 526 - DNA, 18 bp, Artificial Sequence
  Synthetic Polynucleotide
aaatatgtcttgggcacc

SEQ ID NO: 527 - DNA, 18 bp, Artificial Sequence
  Synthetic Polynucleotide
tatcacatctttgtagcc

SEQ ID NO: 528 - DNA, 17 bp, Artificial Sequence
  Synthetic Polynucleotide
tacaaaagcacccaatc

SEQ ID NO: 529 - DNA, 17 bp, Artificial Sequence
  Synthetic Polynucleotide
tgggagggcgatcgcaa

SEQ ID NO: 530 - DNA, 17 bp, Artificial Sequence
  Synthetic Polynucleotide
tggacaggagatcgcaa

SEQ ID NO: 531 - DNA, 17 bp, Artificial Sequence
  Synthetic Polynucleotide
tgggaaggtagtcgcga

SEQ ID NO: 532 - DNA, 17 bp, Artificial Sequence
  Synthetic Polynucleotide
tggacaggagatcgcga

SEQ ID NO: 533 - DNA, 17 bp, Artificial Sequence
  Synthetic Polynucleotide
gtaatgctttcacggct

SEQ ID NO: 534 - DNA, 17 bp, Artificial Sequence
  Synthetic Polynucleotide
gcaacgccttctcggcg

SEQ ID NO: 535 - DNA, 17 bp, Artificial Sequence
  Synthetic Polynucleotide
ggaatgcttttacagct

SEQ ID NO: 536 - DNA, 17 bp, Artificial Sequence
  Synthetic Polynucleotide
gtaacgcatttaccgcc

SEQ ID NO: 537 - DNA, 17 bp, Artificial Sequence
  Synthetic Polynucleotide
ggaatgcgttcacwgck

SEQ ID NO: 538 - DNA, 17 bp, Artificial Sequence
  Synthetic Polynucleotide
gaaatgcgtttacrgca

SEQ ID NO: 539 - DNA, 17 bp, Artificial Sequence
  Synthetic Polynucleotide
gtaatgcctttactgcg

SEQ ID NO: 540 - DNA, 17 bp, Artificial Sequence
  Synthetic Polynucleotide
gaagtgcgtttacagcg

SEQ ID NO: 541 - DNA, 17 bp, Artificial Sequence
  Synthetic Polynucleotide
gcaatgccttcacmgct

SEQ ID NO: 542 - DNA, 17 bp, Artificial Sequence
  Synthetic Polynucleotide
ggaacgccttttcagca

SEQ ID NO: 543 - DNA, 17 bp, Artificial Sequence
  Synthetic Polynucleotide
gtaatgccttcacagcg

SEQ ID NO: 544 - DNA, 17 bp, Artificial Sequence
  Synthetic Polynucleotide
ggaacgcgttcacmgcy

SEQ ID NO: 545 - DNA, 17 bp, Artificial Sequence
  Synthetic Polynucleotide
ggaatgcgttcaccgcc

SEQ ID NO: 546 - DNA, 17 bp, Artificial Sequence
  Synthetic Polynucleotide
ggaatgctttcaccgct

SEQ ID NO: 547 - DNA, 17 bp, Artificial Sequence
  Synthetic Polynucleotide
cctttgcacgccatggg

SEQ ID NO: 548 - DNA, 17 bp, Artificial Sequence
  Synthetic Polynucleotide
ccttygcacgccgtggg

SEQ ID NO: 549 - DNA, 17 bp, Artificial Sequence
  Synthetic Polynucleotide
tgggcgaacgccgtgtg

SEQ ID NO: 550 - DNA, 17 bp, Artificial Sequence
  Synthetic Polynucleotide
tgggtggacgccgtgtg

SEQ ID NO: 551 - DNA, 17 bp, Artificial Sequence
  Synthetic Polynucleotide
tgggtgaacgcbgtgtg

SEQ ID NO: 552 - DNA, 17 bp, Artificial Sequence
  Synthetic Polynucleotide
tggctgaacgccgtgtg

SEQ ID NO: 553 - DNA, 18 bp, Artificial Sequence
  Synthetic Polynucleotide
gaaarggggcgytagggt

SEQ ID NO: 554 - DNA, 18 bp, Artificial Sequence
  Synthetic Polynucleotide
cccacttgcgrcacacrc

SEQ ID NO: 555 - DNA, 18 bp, Artificial Sequence
  Synthetic Polynucleotide
cgacgcttccgytgccgy

SEQ ID NO: 556 - DNA, 18 bp, Artificial Sequence
  Synthetic Polynucleotide
yaaaacctgaggacctgw

SEQ ID NO: 557 - DNA, 18 bp, Artificial Sequence
  Synthetic Polynucleotide
tgatgatggcgtcdaaag

SEQ ID NO: 558 - DNA, 18 bp, Artificial Sequence
  Synthetic Polynucleotide
tatgwctatcyaacggag

SEQ ID NO: 559 - DNA, 10 bp, Artificial Sequence
  Synthetic Polynucleotide
ttgtctggca

SEQ ID NO: 560 - DNA, 10 bp, Artificial Sequence
  Synthetic Polynucleotide
tggaaaagcc

SEQ ID NO: 561 - DNA, 10 bp, Artificial Sequence
  Synthetic Polynucleotide
agtcagccct

SEQ ID NO: 562 - DNA, 10 bp, Artificial Sequence
  Synthetic Polynucleotide
cttggacagc

SEQ ID NO: 563 - DNA, 10 bp, Artificial Sequence
  Synthetic Polynucleotide
tcagttggca

SEQ ID NO: 564 - DNA, 10 bp, Artificial Sequence
  Synthetic Polynucleotide
agaatggcgt

SEQ ID NO: 565 - DNA, 10 bp, Artificial Sequence
  Synthetic Polynucleotide
gcattttgcc

SEQ ID NO: 566 - DNA, 10 bp, Artificial Sequence
  Synthetic Polynucleotide
acaaagcagc

SEQ ID NO: 567 - DNA, 10 bp, Artificial Sequence
  Synthetic Polynucleotide
ctgtgaggcg

SEQ ID NO: 568 - DNA, 10 bp, Artificial Sequence
  Synthetic Polynucleotide
gagggaacca

SEQ ID NO: 569 - DNA, 10 bp, Artificial Sequence
  Synthetic Polynucleotide
ttgaggggcc

SEQ ID NO: 570 - DNA, 10 bp, Artificial Sequence
  Synthetic Polynucleotide
gtgcattggt

SEQ ID NO: 571 - DNA, 10 bp, Artificial Sequence
  Synthetic Polynucleotide
ggctgtgttt

SEQ ID NO: 572 - DNA, 10 bp, Artificial Sequence
  Synthetic Polynucleotide
ccctccaact

SEQ ID NO: 573 - DNA, 10 bp, Artificial Sequence
  Synthetic Polynucleotide
gcacagtgga

SEQ ID NO: 574 - DNA, 10 bp, Artificial Sequence
  Synthetic Polynucleotide
tgaagctggg

SEQ ID NO: 575 - DNA, 10 bp, Artificial Sequence
  Synthetic Polynucleotide
acttgccaag

SEQ ID NO: 576 - DNA, 10 bp, Artificial Sequence
  Synthetic Polynucleotide
ccgtgaccca

SEQ ID NO: 577 - DNA, 10 bp, Artificial Sequence
  Synthetic Polynucleotide
tggggttgtg

SEQ ID NO: 578 - DNA, 10 bp, Artificial Sequence
  Synthetic Polynucleotide
agctgctttg

SEQ ID NO: 579 - DNA, 10 bp, Artificial Sequence
  Synthetic Polynucleotide
tctaccgtca

SEQ ID NO: 580 - DNA, 10 bp, Artificial Sequence
  Synthetic Polynucleotide
ggctcaaggg

SEQ ID NO: 581 - DNA, 10 bp, Artificial Sequence
  Synthetic Polynucleotide
gctgctggtt

SEQ ID NO: 582 - DNA, 10 bp, Artificial Sequence
  Synthetic Polynucleotide
aagtgtggga

SEQ ID NO: 583 - DNA, 10 bp, Artificial Sequence
  Synthetic Polynucleotide
gctttgcccg

SEQ ID NO: 584 - DNA, 10 bp, Artificial Sequence
  Synthetic Polynucleotide
aagcaacagc

SEQ ID NO: 585 - DNA, 10 bp, Artificial Sequence
  Synthetic Polynucleotide
tccaggcact

SEQ ID NO: 586 - DNA, 10 bp, Artificial Sequence
  Synthetic Polynucleotide
acgctttcct

SEQ ID NO: 587 - DNA, 10 bp, Artificial Sequence
  Synthetic Polynucleotide
accatctgga

SEQ ID NO: 588 - DNA, 10 bp, Artificial Sequence
  Synthetic Polynucleotide
tctggtccaa

SEQ ID NO: 589 - DNA, 10 bp, Artificial Sequence
  Synthetic Polynucleotide
tagcaacagc

SEQ ID NO: 590 - DNA, 10 bp, Artificial Sequence
  Synthetic Polynucleotide
atgaccgcaa

SEQ ID NO: 591 - DNA, 10 bp, Artificial Sequence
  Synthetic Polynucleotide
aagggtggcg

SEQ ID NO: 592 - DNA, 10 bp, Artificial Sequence
  Synthetic Polynucleotide
gtggtgacgg

SEQ ID NO: 593 - DNA, 10 bp, Artificial Sequence
  Synthetic Polynucleotide
atcccgcagg

SEQ ID NO: 594 - DNA, 10 bp, Artificial Sequence
  Synthetic Polynucleotide
ggcgatggag

SEQ ID NO: 595 - DNA, 10 bp, Artificial Sequence
  Synthetic Polynucleotide
caccgtgtca

SEQ ID NO: 596 - DNA, 10 bp, Artificial Sequence
  Synthetic Polynucleotide
cacaatgcga

SEQ ID NO: 597 - DNA, 10 bp, Artificial Sequence
  Synthetic Polynucleotide
ttgttgcgac

SEQ ID NO: 598 - DNA, 10 bp, Artificial Sequence
  Synthetic Polynucleotide
cgtcatcgag

SEQ ID NO: 599 - DNA, 10 bp, Artificial Sequence
  Synthetic Polynucleotide
tccattgcag

SEQ ID NO: 600 - DNA, 10 bp, Artificial Sequence
  Synthetic Polynucleotide
atgagctgca

SEQ ID NO: 601 - DNA, 10 bp, Artificial Sequence
  Synthetic Polynucleotide
cccctccaaa

SEQ ID NO: 602 - DNA, 10 bp, Artificial Sequence
  Synthetic Polynucleotide
ttggcatgtg

SEQ ID NO: 603 - DNA, 10 bp, Artificial Sequence
  Synthetic Polynucleotide
tccagtccac

SEQ ID NO: 604 - DNA, 10 bp, Artificial Sequence
  Synthetic Polynucleotide
gcagatgcag

SEQ ID NO: 605 - DNA, 10 bp, Artificial Sequence
  Synthetic Polynucleotide
agcttccaca

SEQ ID NO: 606 - DNA, 10 bp, Artificial Sequence
  Synthetic Polynucleotide
gcaggagcag

SEQ ID NO: 607 - DNA, 10 bp, Artificial Sequence
  Synthetic Polynucleotide
cgctccagtt

SEQ ID NO: 608 - DNA, 10 bp, Artificial Sequence
  Synthetic Polynucleotide
tacgacaaca

SEQ ID NO: 609 - DNA, 10 bp, Artificial Sequence
  Synthetic Polynucleotide
acgtgtacgc

SEQ ID NO: 610 - DNA, 10 bp, Artificial Sequence
  Synthetic Polynucleotide
catttcgccg

SEQ ID NO: 611 - DNA, 10 bp, Artificial Sequence
  Synthetic Polynucleotide
cgacgacgac

SEQ ID NO: 612 - DNA, 10 bp, Artificial Sequence
  Synthetic Polynucleotide
accaccaccg

SEQ ID NO: 613 - DNA, 10 bp, Artificial Sequence
  Synthetic Polynucleotide
tcgcagacac

SEQ ID NO: 614 - DNA, 10 bp, Artificial Sequence
  Synthetic Polynucleotide
tgtgaccagt

SEQ ID NO: 615 - DNA, 10 bp, Artificial Sequence
  Synthetic Polynucleotide
gtcgcaatcg

SEQ ID NO: 616 - DNA, 10 bp, Artificial Sequence
  Synthetic Polynucleotide
aacggttacg

SEQ ID NO: 617 - DNA, 10 bp, Artificial Sequence
  Synthetic Polynucleotide
tcgcaacaaa

SEQ ID NO: 618 - DNA, 10 bp, Artificial Sequence
  Synthetic Polynucleotide
ccgagggtaa

SEQ ID NO: 619 - DNA, 10 bp, Artificial Sequence
  Synthetic Polynucleotide
acatggacga

SEQ ID NO: 620 - DNA, 10 bp, Artificial Sequence
  Synthetic Polynucleotide
cggttcccat

SEQ ID NO: 621 - DNA, 10 bp, Artificial Sequence
  Synthetic Polynucleotide
tcgtgaggag

SEQ ID NO: 622 - DNA, 10 bp, Artificial Sequence
  Synthetic Polynucleotide
tgttagccga

SEQ ID NO: 623 - DNA, 10 bp, Artificial Sequence
  Synthetic Polynucleotide
cccacgacga

SEQ ID NO: 624 - DNA, 10 bp, Artificial Sequence
  Synthetic Polynucleotide
cagactgtgc

SEQ ID NO: 625 - DNA, 10 bp, Artificial Sequence
  Synthetic Polynucleotide
ttggtgcggc

SEQ ID NO: 626 - DNA, 10 bp, Artificial Sequence
  Synthetic Polynucleotide
tgccgcacta

SEQ ID NO: 627 - DNA, 10 bp, Artificial Sequence
  Synthetic Polynucleotide
ggttttgcct

SEQ ID NO: 628 - DNA, 10 bp, Artificial Sequence
  Synthetic Polynucleotide
gcgtcccaga

SEQ ID NO: 629 - DNA, 10 bp, Artificial Sequence
  Synthetic Polynucleotide
gtccagaggc

SEQ ID NO: 630 - DNA, 10 bp, Artificial Sequence
  Synthetic Polynucleotide
accaaaccca

SEQ ID NO: 631 - DNA, 10 bp, Artificial Sequence
  Synthetic Polynucleotide
ttggtggggc

SEQ ID NO: 632 - DNA, 10 bp, Artificial Sequence
  Synthetic Polynucleotide
acgaggacta

SEQ ID NO: 633 - DNA, 10 bp, Artificial Sequence
  Synthetic Polynucleotide
attggtgcga

SEQ ID NO: 634 - DNA, 10 bp, Artificial Sequence
  Synthetic Polynucleotide
tgtggactca

SEQ ID NO: 635 - DNA, 10 bp, Artificial Sequence
  Synthetic Polynucleotide
ccagtggcgg

SEQ ID NO: 636 - DNA, 10 bp, Artificial Sequence
  Synthetic Polynucleotide
gcaacaggca

SEQ ID NO: 637 - DNA, 10 bp, Artificial Sequence
  Synthetic Polynucleotide
ctattggcgg

SEQ ID NO: 638 - DNA, 10 bp, Artificial Sequence
  Synthetic Polynucleotide
tgtccaggca

SEQ ID NO: 639 - DNA, 10 bp, Artificial Sequence
  Synthetic Polynucleotide
ttgcaccagg

SEQ ID NO: 640 - DNA, 10 bp, Artificial Sequence
  Synthetic Polynucleotide
cgtgcctaag

SEQ ID NO: 641 - DNA, 10 bp, Artificial Sequence
  Synthetic Polynucleotide
ggaggcatct

SEQ ID NO: 642 - DNA, 10 bp, Artificial Sequence
  Synthetic Polynucleotide
gtgctcagca

SEQ ID NO: 643 - DNA, 10 bp, Artificial Sequence
  Synthetic Polynucleotide
ccttccgaag

SEQ ID NO: 644 - DNA, 10 bp, Artificial Sequence
  Synthetic Polynucleotide
ccatccagct

SEQ ID NO: 645 - DNA, 10 bp, Artificial Sequence
  Synthetic Polynucleotide
gttgcacccg

SEQ ID NO: 646 - DNA, 10 bp, Artificial Sequence
  Synthetic Polynucleotide
gtcgttgaga

SEQ ID NO: 647 - DNA, 10 bp, Artificial Sequence
  Synthetic Polynucleotide
ggtacccgag

SEQ ID NO: 648 - DNA, 10 bp, Artificial Sequence
  Synthetic Polynucleotide
ccgcattcta

SEQ ID NO: 649 - DNA, 10 bp, Artificial Sequence
  Synthetic Polynucleotide
acgcagacct

SEQ ID NO: 650 - DNA, 10 bp, Artificial Sequence
  Synthetic Polynucleotide
gcatcgttgg

SEQ ID NO: 651 - DNA, 10 bp, Artificial Sequence
  Synthetic Polynucleotide
agacatgggg

SEQ ID NO: 652 - DNA, 10 bp, Artificial Sequence
  Synthetic Polynucleotide
aggggcatcc

SEQ ID NO: 653 - DNA, 10 bp, Artificial Sequence
  Synthetic Polynucleotide
gcctattgcc

SEQ ID NO: 654 - DNA, 10 bp, Artificial Sequence
  Synthetic Polynucleotide
ggggcatcaa

SEQ ID NO: 655 - DNA, 10 bp, Artificial Sequence
  Synthetic Polynucleotide
accgtaccac

SEQ ID NO: 656 - DNA, 10 bp, Artificial Sequence
  Synthetic Polynucleotide
gacgactcgt

SEQ ID NO: 657 - DNA, 10 bp, Artificial Sequence
  Synthetic Polynucleotide
gtggctcgcc

SEQ ID NO: 658 - DNA, 10 bp, Artificial Sequence
  Synthetic Polynucleotide
cgggcatcaa

SEQ ID NO: 659 - DNA, 10 bp, Artificial Sequence
  Synthetic Polynucleotide
cgccatctgg

SEQ ID NO: 660 - DNA, 10 bp, Artificial Sequence
  Synthetic Polynucleotide
cttaggggca

SEQ ID NO: 661 - DNA, 10 bp, Artificial Sequence
  Synthetic Polynucleotide
ctccactggg

SEQ ID NO: 662 - DNA, 10 bp, Artificial Sequence
  Synthetic Polynucleotide
aggggcatcc

SEQ ID NO: 663 - DNA, 10 bp, Artificial Sequence
  Synthetic Polynucleotide
gcccattgta

SEQ ID NO: 664 - DNA, 10 bp, Artificial Sequence
  Synthetic Polynucleotide
actgacgttg

SEQ ID NO: 665 - DNA, 10 bp, Artificial Sequence
  Synthetic Polynucleotide
tccttgctct

SEQ ID NO: 666 - DNA, 10 bp, Artificial Sequence
  Synthetic Polynucleotide
gcatcaccag

SEQ ID NO: 667 - DNA, 10 bp, Artificial Sequence
  Synthetic Polynucleotide
taccaccaga

SEQ ID NO: 668 - DNA, 10 bp, Artificial Sequence
  Synthetic Polynucleotide
tcgaactcct

SEQ ID NO: 669 - DNA, 10 bp, Artificial Sequence
  Synthetic Polynucleotide
tggactgaga

SEQ ID NO: 670 - DNA, 10 bp, Artificial Sequence
  Synthetic Polynucleotide
cacaccacca

SEQ ID NO: 671 - DNA, 10 bp, Artificial Sequence
  Synthetic Polynucleotide
cccataggga

SEQ ID NO: 672 - DNA, 10 bp, Artificial Sequence
  Synthetic Polynucleotide
ccggagtgaa

SEQ ID NO: 673 - DNA, 10 bp, Artificial Sequence
  Synthetic Polynucleotide
cgctgctatg

SEQ ID NO: 674 - DNA, 10 bp, Artificial Sequence
  Synthetic Polynucleotide
gaatgtcgct

SEQ ID NO: 675 - DNA, 10 bp, Artificial Sequence
  Synthetic Polynucleotide
tgtgcgagac

SEQ ID NO: 676 - DNA, 10 bp, Artificial Sequence
  Synthetic Polynucleotide
gacctcgtcc

SEQ ID NO: 677 - DNA, 10 bp, Artificial Sequence
  Synthetic Polynucleotide
tttccaccga

SEQ ID NO: 678 - DNA, 10 bp, Artificial Sequence
  Synthetic Polynucleotide
tcgctgactt

SEQ ID NO: 679 - DNA, 10 bp, Artificial Sequence
  Synthetic Polynucleotide
ttcggctgag

SEQ ID NO: 680 - DNA, 10 bp, Artificial Sequence
  Synthetic Polynucleotide
ctcggctgtc

SEQ ID NO: 681 - DNA, 10 bp, Artificial Sequence
  Synthetic Polynucleotide
ctcacggagt

SEQ ID NO: 682 - DNA, 10 bp, Artificial Sequence
  Synthetic Polynucleotide
cagcaaaggt

SEQ ID NO: 683 - DNA, 10 bp, Artificial Sequence
  Synthetic Polynucleotide
tttctgggct

SEQ ID NO: 684 - DNA, 10 bp, Artificial Sequence
  Synthetic Polynucleotide
ggggtaacgc

SEQ ID NO: 685 - DNA, 10 bp, Artificial Sequence
  Synthetic Polynucleotide
tagctgttga

SEQ ID NO: 686 - DNA, 10 bp, Artificial Sequence
  Synthetic Polynucleotide
tcggcctaca

SEQ ID NO: 687 - DNA, 10 bp, Artificial Sequence
  Synthetic Polynucleotide
tccgatgaga

SEQ ID NO: 688 - DNA, 10 bp, Artificial Sequence
  Synthetic Polynucleotide
cttccgacag

SEQ ID NO: 689 - DNA, 10 bp, Artificial Sequence
  Synthetic Polynucleotide
tgtcgctggg

SEQ ID NO: 690 - DNA, 10 bp, Artificial Sequence
  Synthetic Polynucleotide
tcccttgacg

SEQ ID NO: 691 - DNA, 10 bp, Artificial Sequence
  Synthetic Polynucleotide
gttcctcgct

SEQ ID NO: 692 - DNA, 10 bp, Artificial Sequence
  Synthetic Polynucleotide
ccggagacag

SEQ ID NO: 693 - DNA, 10 bp, Artificial Sequence
  Synthetic Polynucleotide
gccttgcatg

SEQ ID NO: 694 - DNA, 10 bp, Artificial Sequence
  Synthetic Polynucleotide
cgagcctcct

SEQ ID NO: 695 - DNA, 10 bp, Artificial Sequence
  Synthetic Polynucleotide
atgacgcagt

SEQ ID NO: 696 - DNA, 10 bp, Artificial Sequence
  Synthetic Polynucleotide
tcccagtcgg

SEQ ID NO: 697 - DNA, 10 bp, Artificial Sequence
  Synthetic Polynucleotide
cagtgtcagc

SEQ ID NO: 698 - DNA, 10 bp, Artificial Sequence
  Synthetic Polynucleotide
cctccttcca

SEQ ID NO: 699 - DNA, 10 bp, Artificial Sequence
  Synthetic Polynucleotide
tgctcatggc

SEQ ID NO: 700 - DNA, 10 bp, Artificial Sequence
  Synthetic Polynucleotide
gggtcaggct

SEQ ID NO: 701 - DNA, 10 bp, Artificial Sequence
  Synthetic Polynucleotide
cagcacagtg

SEQ ID NO: 702 - DNA, 10 bp, Artificial Sequence
  Synthetic Polynucleotide
ggtccagttg

SEQ ID NO: 703 - DNA, 10 bp, Artificial Sequence
  Synthetic Polynucleotide
tgggtgtttg

SEQ ID NO: 704 - DNA, 10 bp, Artificial Sequence
  Synthetic Polynucleotide
ggacctccaa

SEQ ID NO: 705 - DNA, 10 bp, Artificial Sequence
  Synthetic Polynucleotide
ttgctgcttg

SEQ ID NO: 706 - DNA, 10 bp, Artificial Sequence
  Synthetic Polynucleotide
tcagaggcat

SEQ ID NO: 707 - DNA, 10 bp, Artificial Sequence
  Synthetic Polynucleotide
agctcagtgg

SEQ ID NO: 708 - DNA, 10 bp, Artificial Sequence
  Synthetic Polynucleotide
cgcacagccc

SEQ ID NO: 709 - DNA, 10 bp, Artificial Sequence
  Synthetic Polynucleotide
tctgctttgg

SEQ ID NO: 710 - DNA, 10 bp, Artificial Sequence
  Synthetic Polynucleotide
aagctcccta

SEQ ID NO: 711 - DNA, 10 bp, Artificial Sequence
  Synthetic Polynucleotide
tcttggcatc

SEQ ID NO: 712 - DNA, 10 bp, Artificial Sequence
  Synthetic Polynucleotide
gctcaagccc

SEQ ID NO: 713 - DNA, 10 bp, Artificial Sequence
  Synthetic Polynucleotide
agacgggcag

SEQ ID NO: 714 - DNA, 10 bp, Artificial Sequence
  Synthetic Polynucleotide
tggttgagga

SEQ ID NO: 715 - DNA, 10 bp, Artificial Sequence
  Synthetic Polynucleotide
ccacaacgga

SEQ ID NO: 716 - DNA, 10 bp, Artificial Sequence
  Synthetic Polynucleotide
ggcagtggaa

SEQ ID NO: 717 - DNA, 10 bp, Artificial Sequence
  Synthetic Polynucleotide
gcgaaggtca

SEQ ID NO: 718 - DNA, 10 bp, Artificial Sequence
  Synthetic Polynucleotide
tcccaaagca

SEQ ID NO: 719 - DNA, 10 bp, Artificial Sequence
  Synthetic Polynucleotide
cttgcagggc

SEQ ID NO: 720 - DNA, 10 bp, Artificial Sequence
  Synthetic Polynucleotide
tgtgcggtga

SEQ ID NO: 721 - DNA, 10 bp, Artificial Sequence
  Synthetic Polynucleotide
gtttgagcca

SEQ ID NO: 722 - DNA, 10 bp, Artificial Sequence
  Synthetic Polynucleotide
gatgccatga

SEQ ID NO: 723 - DNA, 10 bp, Artificial Sequence
  Synthetic Polynucleotide
tgaaggcaga

SEQ ID NO: 724 - DNA, 10 bp, Artificial Sequence
  Synthetic Polynucleotide
cgcaagatgt

SEQ ID NO: 725 - DNA, 10 bp, Artificial Sequence
  Synthetic Polynucleotide
tatggtgcag

SEQ ID NO: 726 - DNA, 10 bp, Artificial Sequence
  Synthetic Polynucleotide
tagtgtgctc

SEQ ID NO: 727 - DNA, 10 bp, Artificial Sequence
  Synthetic Polynucleotide
aatgggtggg

SEQ ID NO: 728 - DNA, 10 bp, Artificial Sequence
  Synthetic Polynucleotide
tcacagcttg

SEQ ID NO: 729 - DNA, 10 bp, Artificial Sequence
  Synthetic Polynucleotide
cagagactgc

SEQ ID NO: 730 - DNA, 10 bp, Artificial Sequence
  Synthetic Polynucleotide
gcagctctta

SEQ ID NO: 731 - DNA, 10 bp, Artificial Sequence
  Synthetic Polynucleotide
tcaggatggt

SEQ ID NO: 732 - DNA, 10 bp, Artificial Sequence
  Synthetic Polynucleotide
tggtgcagct

SEQ ID NO: 733 - DNA, 10 bp, Artificial Sequence
  Synthetic Polynucleotide
catggggttc

SEQ ID NO: 734 - DNA, 10 bp, Artificial Sequence
  Synthetic Polynucleotide
tacgtgcata

SEQ ID NO: 735 - DNA, 10 bp, Artificial Sequence
  Synthetic Polynucleotide
tgggtgatga

SEQ ID NO: 736 - DNA, 10 bp, Artificial Sequence
  Synthetic Polynucleotide
tactgtccca

SEQ ID NO: 737 - DNA, 10 bp, Artificial Sequence
  Synthetic Polynucleotide
tggcatggac

SEQ ID NO: 738 - DNA, 10 bp, Artificial Sequence
  Synthetic Polynucleotide
gagagggaga

SEQ ID NO: 739 - DNA, 10 bp, Artificial Sequence
  Synthetic Polynucleotide
aacctcagca

SEQ ID NO: 740 - DNA, 10 bp, Artificial Sequence
  Synthetic Polynucleotide
cccatctggg

SEQ ID NO: 741 - DNA, 10 bp, Artificial Sequence
  Synthetic Polynucleotide
tggttttgcc

SEQ ID NO: 742 - DNA, 10 bp, Artificial Sequence
  Synthetic Polynucleotide
gctgttgcaa

SEQ ID NO: 743 - DNA, 10 bp, Artificial Sequence
  Synthetic Polynucleotide
acagcatggc

SEQ ID NO: 744 - DNA, 10 bp, Artificial Sequence
  Synthetic Polynucleotide
accacccacc

SEQ ID NO: 745 - DNA, 10 bp, Artificial Sequence
  Synthetic Polynucleotide
ttgccaggta

SEQ ID NO: 746 - DNA, 10 bp, Artificial Sequence
  Synthetic Polynucleotide
ccctgttgga

SEQ ID NO: 747 - DNA, 10 bp, Artificial Sequence
  Synthetic Polynucleotide
gctggaatga

SEQ ID NO: 748 - DNA, 10 bp, Artificial Sequence
  Synthetic Polynucleotide
tgcaccatca

SEQ ID NO: 749 - DNA, 10 bp, Artificial Sequence
  Synthetic Polynucleotide
ggtgcatggg

SEQ ID NO: 750 - DNA, 10 bp, Artificial Sequence
  Synthetic Polynucleotide
gagcaatcga

SEQ ID NO: 751 - DNA, 10 bp, Artificial Sequence
  Synthetic Polynucleotide
ggtcctccaa

SEQ ID NO: 752 - DNA, 10 bp, Artificial Sequence
  Synthetic Polynucleotide
ggccttcttc

SEQ ID NO: 753 - DNA, 10 bp, Artificial Sequence
  Synthetic Polynucleotide
cctcaacgga

SEQ ID NO: 754 - DNA, 10 bp, Artificial Sequence
  Synthetic Polynucleotide
cgcaggaaca

SEQ ID NO: 755 - DNA, 10 bp, Artificial Sequence
  Synthetic Polynucleotide
agtcaggtga

SEQ ID NO: 756 - DNA, 10 bp, Artificial Sequence
  Synthetic Polynucleotide
ggcattgaca

SEQ ID NO: 757 - DNA, 10 bp, Artificial Sequence
  Synthetic Polynucleotide
aggatgcaga

SEQ ID NO: 758 - DNA, 10 bp, Artificial Sequence
  Synthetic Polynucleotide
cagcagcaaa

SEQ ID NO: 759 - DNA, 10 bp, Artificial Sequence
  Synthetic Polynucleotide
aggcagcata

SEQ ID NO: 760 - DNA, 10 bp, Artificial Sequence
  Synthetic Polynucleotide
accaaggaga

SEQ ID NO: 761 - DNA, 10 bp, Artificial Sequence
  Synthetic Polynucleotide
tggttgcaag

SEQ ID NO: 762 - DNA, 10 bp, Artificial Sequence
  Synthetic Polynucleotide
actgactgca

SEQ ID NO: 763 - DNA, 10 bp, Artificial Sequence
  Synthetic Polynucleotide
aaccacttgc

SEQ ID NO: 764 - DNA, 10 bp, Artificial Sequence
  Synthetic Polynucleotide
tagtgtgcta

SEQ ID NO: 765 - DNA, 10 bp, Artificial Sequence
  Synthetic Polynucleotide
tggatgtgca

SEQ ID NO: 766 - DNA, 10 bp, Artificial Sequence
  Synthetic Polynucleotide
gtcatctggc

SEQ ID NO: 767 - DNA, 10 bp, Artificial Sequence
  Synthetic Polynucleotide
cgccatgaac

SEQ ID NO: 768 - DNA, 10 bp, Artificial Sequence
  Synthetic Polynucleotide
cacggcccca

SEQ ID NO: 769 - DNA, 10 bp, Artificial Sequence
  Synthetic Polynucleotide
tggcccttgc

SEQ ID NO: 770 - DNA, 10 bp, Artificial Sequence
  Synthetic Polynucleotide
gttgccatca

SEQ ID NO: 771 - DNA, 10 bp, Artificial Sequence
  Synthetic Polynucleotide
gaccctggtg

SEQ ID NO: 772 - DNA, 10 bp, Artificial Sequence
  Synthetic Polynucleotide
tatgctccct

SEQ ID NO: 773 - DNA, 10 bp, Artificial Sequence
  Synthetic Polynucleotide
tgggtgggtt

SEQ ID NO: 774 - DNA, 10 bp, Artificial Sequence
  Synthetic Polynucleotide
cccattcacc

SEQ ID NO: 775 - DNA, 10 bp, Artificial Sequence
  Synthetic Polynucleotide
gtggtgatgg

SEQ ID NO: 776 - DNA, 10 bp, Artificial Sequence
  Synthetic Polynucleotide
tagcttgcag

SEQ ID NO: 777 - DNA, 10 bp, Artificial Sequence
  Synthetic Polynucleotide
acaagcaggt

SEQ ID NO: 778 - DNA, 10 bp, Artificial Sequence
  Synthetic Polynucleotide
cacagtgcaa

SEQ ID NO: 779 - DNA, 10 bp, Artificial Sequence
  Synthetic Polynucleotide
tcagaaggct

SEQ ID NO: 780 - DNA, 10 bp, Artificial Sequence
  Synthetic Polynucleotide
tcagctctgg

SEQ ID NO: 781 - DNA, 10 bp, Artificial Sequence
  Synthetic Polynucleotide
ccaacatgcc

SEQ ID NO: 782 - DNA, 10 bp, Artificial Sequence
  Synthetic Polynucleotide
catgcacagg

SEQ ID NO: 783 - DNA, 10 bp, Artificial Sequence
  Synthetic Polynucleotide
cccaccaaga

SEQ ID NO: 784 - DNA, 10 bp, Artificial Sequence
  Synthetic Polynucleotide
ccgcaggaac

SEQ ID NO: 785 - DNA, 10 bp, Artificial Sequence
  Synthetic Polynucleotide
ggcaattgga

SEQ ID NO: 786 - DNA, 10 bp, Artificial Sequence
  Synthetic Polynucleotide
tgggcattga

SEQ ID NO: 787 - DNA, 10 bp, Artificial Sequence
  Synthetic Polynucleotide
tggagttgca

SEQ ID NO: 788 - DNA, 10 bp, Artificial Sequence
  Synthetic Polynucleotide
cagcactcac

SEQ ID NO: 789 - DNA, 10 bp, Artificial Sequence
  Synthetic Polynucleotide
gatgggcttc

SEQ ID NO: 790 - DNA, 10 bp, Artificial Sequence
  Synthetic Polynucleotide
acatccccta

SEQ ID NO: 791 - DNA, 10 bp, Artificial Sequence
  Synthetic Polynucleotide
gcagacaaga

SEQ ID NO: 792 - DNA, 10 bp, Artificial Sequence
  Synthetic Polynucleotide
tgctgttctg

SEQ ID NO: 793 - DNA, 10 bp, Artificial Sequence
  Synthetic Polynucleotide
caccacatgg

SEQ ID NO: 794 - DNA, 10 bp, Artificial Sequence
  Synthetic Polynucleotide
cgttgccgca

SEQ ID NO: 795 - DNA, 10 bp, Artificial Sequence
  Synthetic Polynucleotide
gctgcatcag

SEQ ID NO: 796 - DNA, 10 bp, Artificial Sequence
  Synthetic Polynucleotide
actctgccat

SEQ ID NO: 797 - DNA, 10 bp, Artificial Sequence
  Synthetic Polynucleotide
tgaaggctct

SEQ ID NO: 798 - DNA, 10 bp, Artificial Sequence
  Synthetic Polynucleotide
gcaaaagcac

SEQ ID NO: 799 - DNA, 10 bp, Artificial Sequence
  Synthetic Polynucleotide
tccatgaagc

SEQ ID NO: 800 - DNA, 10 bp, Artificial Sequence
  Synthetic Polynucleotide
gagcaatcga

SEQ ID NO: 801 - DNA, 10 bp, Artificial Sequence
  Synthetic Polynucleotide
cttgccatca

SEQ ID NO: 802 - DNA, 10 bp, Artificial Sequence
  Synthetic Polynucleotide
tagtgtgcta

SEQ ID NO: 803 - DNA, 10 bp, Artificial Sequence
  Synthetic Polynucleotide
gcgccagtag

SEQ ID NO: 804 - DNA, 10 bp, Artificial Sequence
  Synthetic Polynucleotide
agccttctga

SEQ ID NO: 805 - DNA, 10 bp, Artificial Sequence
  Synthetic Polynucleotide
ggtcaagctc

SEQ ID NO: 806 - DNA, 10 bp, Artificial Sequence
  Synthetic Polynucleotide
tgcactagca

SEQ ID NO: 807 - DNA, 10 bp, Artificial Sequence
  Synthetic Polynucleotide
gatgggcaac

SEQ ID NO: 808 - DNA, 10 bp, Artificial Sequence
  Synthetic Polynucleotide
taagggcata

SEQ ID NO: 809 - DNA, 10 bp, Artificial Sequence
  Synthetic Polynucleotide
gactgctcag

SEQ ID NO: 810 - DNA, 10 bp, Artificial Sequence
  Synthetic Polynucleotide
cctgccactc

SEQ ID NO: 811 - DNA, 10 bp, Artificial Sequence
  Synthetic Polynucleotide
tgcaaatgga

SEQ ID NO: 812 - DNA, 10 bp, Artificial Sequence
  Synthetic Polynucleotide
tcaggcaact

SEQ ID NO: 813 - DNA, 10 bp, Artificial Sequence
  Synthetic Polynucleotide
tgcaaacctg

SEQ ID NO: 814 - DNA, 10 bp, Artificial Sequence
  Synthetic Polynucleotide
tcagtcctca

SEQ ID NO: 815 - DNA, 10 bp, Artificial Sequence
  Synthetic Polynucleotide
gtgtgccagg

SEQ ID NO: 816 - DNA, 10 bp, Artificial Sequence
  Synthetic Polynucleotide
tcgcatcccc

SEQ ID NO: 817 - DNA, 10 bp, Artificial Sequence
  Synthetic Polynucleotide
caggcaatga

SEQ ID NO: 818 - DNA, 10 bp, Artificial Sequence
  Synthetic Polynucleotide
tctggagaca

SEQ ID NO: 819 - DNA, 10 bp, Artificial Sequence
  Synthetic Polynucleotide
caggattggc

SEQ ID NO: 820 - DNA, 10 bp, Artificial Sequence
  Synthetic Polynucleotide
tcaccaggat

SEQ ID NO: 821 - DNA, 10 bp, Artificial Sequence
  Synthetic Polynucleotide
atgtctggga

SEQ ID NO: 822 - DNA, 10 bp, Artificial Sequence
  Synthetic Polynucleotide
ttgcagcttg

SEQ ID NO: 823 - DNA, 10 bp, Artificial Sequence
  Synthetic Polynucleotide
atgcatccca

SEQ ID NO: 824 - DNA, 10 bp, Artificial Sequence
  Synthetic Polynucleotide
caaagaccgg

SEQ ID NO: 825 - DNA, 10 bp, Artificial Sequence
  Synthetic Polynucleotide
taggtgggcc

SEQ ID NO: 826 - DNA, 10 bp, Artificial Sequence
  Synthetic Polynucleotide
ctgtcacggt

SEQ ID NO: 827 - DNA, 10 bp, Artificial Sequence
  Synthetic Polynucleotide
cagcttgtgg

SEQ ID NO: 828 - DNA, 10 bp, Artificial Sequence
  Synthetic Polynucleotide
taaccactgg

SEQ ID NO: 829 - DNA, 10 bp, Artificial Sequence
  Synthetic Polynucleotide
cgctcgaatt

SEQ ID NO: 830 - DNA, 10 bp, Artificial Sequence
  Synthetic Polynucleotide
gagtgctcac

SEQ ID NO: 831 - DNA, 10 bp, Artificial Sequence
  Synthetic Polynucleotide
acagccagtt

SEQ ID NO: 832 - DNA, 10 bp, Artificial Sequence
  Synthetic Polynucleotide
gggcgtatga

SEQ ID NO: 833 - DNA, 10 bp, Artificial Sequence
  Synthetic Polynucleotide
tgacacacca

SEQ ID NO: 834 - DNA, 10 bp, Artificial Sequence
  Synthetic Polynucleotide
ctgctgtccc

SEQ ID NO: 835 - DNA, 10 bp, Artificial Sequence
  Synthetic Polynucleotide
atgggaacgt

SEQ ID NO: 836 - DNA, 10 bp, Artificial Sequence
  Synthetic Polynucleotide
caccattgct

SEQ ID NO: 837 - DNA, 10 bp, Artificial Sequence
  Synthetic Polynucleotide
ggcaaactgc

SEQ ID NO: 838 - DNA, 10 bp, Artificial Sequence
  Synthetic Polynucleotide
tacccctgaa

SEQ ID NO: 839 - DNA, 10 bp, Artificial Sequence
  Synthetic Polynucleotide
acagaacccc

SEQ ID NO: 840 - DNA, 10 bp, Artificial Sequence
  Synthetic Polynucleotide
acaggaacca

SEQ ID NO: 841 - DNA, 10 bp, Artificial Sequence
  Synthetic Polynucleotide
gccatgtcct

SEQ ID NO: 842 - DNA, 10 bp, Artificial Sequence
  Synthetic Polynucleotide
gctctgcaag

SEQ ID NO: 843 - DNA, 10 bp, Artificial Sequence
  Synthetic Polynucleotide
gtggcgacat

SEQ ID NO: 844 - DNA, 10 bp, Artificial Sequence
  Synthetic Polynucleotide
cacggacctg

SEQ ID NO: 845 - DNA, 10 bp, Artificial Sequence
  Synthetic Polynucleotide
tagctgtgga

SEQ ID NO: 846 - DNA, 10 bp, Artificial Sequence
  Synthetic Polynucleotide
taggctccct

SEQ ID NO: 847 - DNA, 10 bp, Artificial Sequence
  Synthetic Polynucleotide
agggtggttt

SEQ ID NO: 848 - DNA, 10 bp, Artificial Sequence
  Synthetic Polynucleotide
caaccccatg

SEQ ID NO: 849 - DNA, 10 bp, Artificial Sequence
  Synthetic Polynucleotide
caggaccaac

SEQ ID NO: 850 - DNA, 10 bp, Artificial Sequence
  Synthetic Polynucleotide
ctgtttggcc

SEQ ID NO: 851 - DNA, 10 bp, Artificial Sequence
  Synthetic Polynucleotide
gacttcgtga

SEQ ID NO: 852 - DNA, 10 bp, Artificial Sequence
  Synthetic Polynucleotide
ttggtggcat

SEQ ID NO: 853 - DNA, 10 bp, Artificial Sequence
  Synthetic Polynucleotide
gtgacaccag

SEQ ID NO: 854 - DNA, 10 bp, Artificial Sequence
  Synthetic Polynucleotide
tccccattga

SEQ ID NO: 855 - DNA, 10 bp, Artificial Sequence
  Synthetic Polynucleotide
tgcctgtgca

SEQ ID NO: 856 - DNA, 10 bp, Artificial Sequence
  Synthetic Polynucleotide
gcttgtctgc

SEQ ID NO: 857 - DNA, 10 bp, Artificial Sequence
  Synthetic Polynucleotide
gagcaatcgg

SEQ ID NO: 858 - DNA, 10 bp, Artificial Sequence
  Synthetic Polynucleotide
ttgcgtgtga

SEQ ID NO: 859 - DNA, 10 bp, Artificial Sequence
  Synthetic Polynucleotide
ggccttcggg

SEQ ID NO: 860 - DNA, 10 bp, Artificial Sequence
  Synthetic Polynucleotide
ttgaagctgc

SEQ ID NO: 861 - DNA, 10 bp, Artificial Sequence
  Synthetic Polynucleotide
cagccattca

SEQ ID NO: 862 - DNA, 10 bp, Artificial Sequence
  Synthetic Polynucleotide
tccacaagct

SEQ ID NO: 863 - DNA, 10 bp, Artificial Sequence
  Synthetic Polynucleotide
gaccagaggt

SEQ ID NO: 864 - DNA, 10 bp, Artificial Sequence
  Synthetic Polynucleotide
accaacacct

SEQ ID NO: 865 - DNA, 10 bp, Artificial Sequence
  Synthetic Polynucleotide
tgatgcacct

SEQ ID NO: 866 - DNA, 10 bp, Artificial Sequence
  Synthetic Polynucleotide
ttcaggcgtg

SEQ ID NO: 867 - DNA, 10 bp, Artificial Sequence
  Synthetic Polynucleotide
tagctgcaag

SEQ ID NO: 868 - DNA, 10 bp, Artificial Sequence
  Synthetic Polynucleotide
atcttgggct

SEQ ID NO: 869 - DNA, 10 bp, Artificial Sequence
  Synthetic Polynucleotide
tttggggagg

SEQ ID NO: 870 - DNA, 10 bp, Artificial Sequence
  Synthetic Polynucleotide
gctccaccta

SEQ ID NO: 871 - DNA, 10 bp, Artificial Sequence
  Synthetic Polynucleotide
tcacatggga

SEQ ID NO: 872 - DNA, 10 bp, Artificial Sequence
  Synthetic Polynucleotide
ctgctcctca

SEQ ID NO: 873 - DNA, 10 bp, Artificial Sequence
  Synthetic Polynucleotide
agctcctgtt

SEQ ID NO: 874 - DNA, 10 bp, Artificial Sequence
  Synthetic Polynucleotide
atcccacacc

SEQ ID NO: 875 - DNA, 10 bp, Artificial Sequence
  Synthetic Polynucleotide
accgtaagga

SEQ ID NO: 876 - DNA, 10 bp, Artificial Sequence
  Synthetic Polynucleotide
aggcgaactg

SEQ ID NO: 877 - DNA, 10 bp, Artificial Sequence
  Synthetic Polynucleotide
gttgctttgc

SEQ ID NO: 878 - DNA, 10 bp, Artificial Sequence
  Synthetic Polynucleotide
gcactcctcc

SEQ ID NO: 879 - DNA, 10 bp, Artificial Sequence
  Synthetic Polynucleotide
cctgatggga

SEQ ID NO: 880 - DNA, 10 bp, Artificial Sequence
  Synthetic Polynucleotide
ccctagctcc

SEQ ID NO: 881 - DNA, 10 bp, Artificial Sequence
  Synthetic Polynucleotide
ccagtgtcac

SEQ ID NO: 882 - DNA, 10 bp, Artificial Sequence
  Synthetic Polynucleotide
tatgggctgc

SEQ ID NO: 883 - DNA, 10 bp, Artificial Sequence
  Synthetic Polynucleotide
ggctgtagct

SEQ ID NO: 884 - DNA, 10 bp, Artificial Sequence
  Synthetic Polynucleotide
acaactgctg

SEQ ID NO: 885 - DNA, 10 bp, Artificial Sequence
  Synthetic Polynucleotide
agtgggtcac

SEQ ID NO: 886 - DNA, 10 bp, Artificial Sequence
  Synthetic Polynucleotide
cggcctgact

SEQ ID NO: 887 - DNA, 10 bp, Artificial Sequence
  Synthetic Polynucleotide
tgggatgaga

SEQ ID NO: 888 - DNA, 10 bp, Artificial Sequence
  Synthetic Polynucleotide
tcaagcctcc

SEQ ID NO: 889 - DNA, 10 bp, Artificial Sequence
  Synthetic Polynucleotide
ggtcaagctc

SEQ ID NO: 890 - DNA, 10 bp, Artificial Sequence
  Synthetic Polynucleotide
tcatggcaca

SEQ ID NO: 891 - DNA, 10 bp, Artificial Sequence
  Synthetic Polynucleotide
cagggaacac

SEQ ID NO: 892 - DNA, 10 bp, Artificial Sequence
  Synthetic Polynucleotide
ctgcatgtgc

SEQ ID NO: 893 - DNA, 10 bp, Artificial Sequence
  Synthetic Polynucleotide
tagaatgcga

SEQ ID NO: 894 - DNA, 10 bp, Artificial Sequence
  Synthetic Polynucleotide
tcatttggca

SEQ ID NO: 895 - DNA, 10 bp, Artificial Sequence
  Synthetic Polynucleotide
agctgaggtc

SEQ ID NO: 896 - DNA, 10 bp, Artificial Sequence
  Synthetic Polynucleotide
tccaacaagc

SEQ ID NO: 897 - DNA, 10 bp, Artificial Sequence
  Synthetic Polynucleotide
actggctgac

SEQ ID NO: 898 - DNA, 10 bp, Artificial Sequence
  Synthetic Polynucleotide
ccaacctggg

SEQ ID NO: 899 - DNA, 10 bp, Artificial Sequence
  Synthetic Polynucleotide
tggtgagcta

SEQ ID NO: 900 - DNA, 10 bp, Artificial Sequence
  Synthetic Polynucleotide
tactgatgcc

SEQ ID NO: 901 - DNA, 10 bp, Artificial Sequence
  Synthetic Polynucleotide
tgcaaccaag

SEQ ID NO: 902 - DNA, 10 bp, Artificial Sequence
  Synthetic Polynucleotide
gctcttggtg

SEQ ID NO: 903 - DNA, 10 bp, Artificial Sequence
  Synthetic Polynucleotide
aatccagggg

SEQ ID NO: 904 - DNA, 10 bp, Artificial Sequence
  Synthetic Polynucleotide
ggagggcgat

SEQ ID NO: 905 - DNA, 10 bp, Artificial Sequence
  Synthetic Polynucleotide
tgaagatcgc

SEQ ID NO: 906 - DNA, 10 bp, Artificial Sequence
  Synthetic Polynucleotide
gagcttcgtg

SEQ ID NO: 907 - DNA, 10 bp, Artificial Sequence
  Synthetic Polynucleotide
gtgaagggca

SEQ ID NO: 908 - DNA, 10 bp, Artificial Sequence
  Synthetic Polynucleotide
gggactccac

SEQ ID NO: 909 - DNA, 10 bp, Artificial Sequence
  Synthetic Polynucleotide
ccagcggtca

SEQ ID NO: 910 - DNA, 10 bp, Artificial Sequence
  Synthetic Polynucleotide
aatggctgga

SEQ ID NO: 911 - DNA, 10 bp, Artificial Sequence
  Synthetic Polynucleotide
agaattgccg

SEQ ID NO: 912 - DNA, 10 bp, Artificial Sequence
  Synthetic Polynucleotide
ggcatcaaca

SEQ ID NO: 913 - DNA, 10 bp, Artificial Sequence
  Synthetic Polynucleotide
ttcccacagg

SEQ ID NO: 914 - DNA, 10 bp, Artificial Sequence
  Synthetic Polynucleotide
tgtgattggc

SEQ ID NO: 915 - DNA, 10 bp, Artificial Sequence
  Synthetic Polynucleotide
tccacaagct

SEQ ID NO: 916 - DNA, 10 bp, Artificial Sequence
  Synthetic Polynucleotide
cctcagggtg

SEQ ID NO: 917 - DNA, 10 bp, Artificial Sequence
  Synthetic Polynucleotide
tgagaggtgg

SEQ ID NO: 918 - DNA, 10 bp, Artificial Sequence
  Synthetic Polynucleotide
tgcatggtga

SEQ ID NO: 919 - DNA, 10 bp, Artificial Sequence
  Synthetic Polynucleotide
tgatcgtgca

SEQ ID NO: 920 - DNA, 10 bp, Artificial Sequence
  Synthetic Polynucleotide
tggaccacat

SEQ ID NO: 921 - DNA, 10 bp, Artificial Sequence
  Synthetic Polynucleotide
gggctaggag

SEQ ID NO: 922 - DNA, 10 bp, Artificial Sequence
  Synthetic Polynucleotide
actcaaccca

SEQ ID NO: 923 - DNA, 10 bp, Artificial Sequence
  Synthetic Polynucleotide
ctgcgggtta

SEQ ID NO: 924 - DNA, 10 bp, Artificial Sequence
  Synthetic Polynucleotide
ggcccctgac

SEQ ID NO: 925 - DNA, 10 bp, Artificial Sequence
  Synthetic Polynucleotide
gcagcagaca

SEQ ID NO: 926 - DNA, 10 bp, Artificial Sequence
  Synthetic Polynucleotide
gggcaccacg

SEQ ID NO: 927 - DNA, 10 bp, Artificial Sequence
  Synthetic Polynucleotide
gcacatccac

SEQ ID NO: 928 - DNA, 10 bp, Artificial Sequence
  Synthetic Polynucleotide
tgcaccacaa

SEQ ID NO: 929 - DNA, 10 bp, Artificial Sequence
  Synthetic Polynucleotide
gggttgtgta

SEQ ID NO: 930 - DNA, 10 bp, Artificial Sequence
  Synthetic Polynucleotide
gcgagttagg

SEQ ID NO: 931 - DNA, 10 bp, Artificial Sequence
  Synthetic Polynucleotide
gcagcatctt

SEQ ID NO: 932 - DNA, 10 bp, Artificial Sequence
  Synthetic Polynucleotide
gttgcggccc

SEQ ID NO: 933 - DNA, 10 bp, Artificial Sequence
  Synthetic Polynucleotide
acggcctcct

SEQ ID NO: 934 - DNA, 10 bp, Artificial Sequence
  Synthetic Polynucleotide
tgtgttgagc

SEQ ID NO: 935 - DNA, 10 bp, Artificial Sequence
  Synthetic Polynucleotide
tccatttgca

SEQ ID NO: 936 - DNA, 10 bp, Artificial Sequence
  Synthetic Polynucleotide
taagcccaac

SEQ ID NO: 937 - DNA, 10 bp, Artificial Sequence
  Synthetic Polynucleotide
tccacttgca

SEQ ID NO: 938 - DNA, 10 bp, Artificial Sequence
  Synthetic Polynucleotide
tgcaccagca

SEQ ID NO: 939 - DNA, 10 bp, Artificial Sequence
  Synthetic Polynucleotide
gccactcata

SEQ ID NO: 940 - DNA, 10 bp, Artificial Sequence
  Synthetic Polynucleotide
tggaaatgcc

SEQ ID NO: 941 - DNA, 10 bp, Artificial Sequence
  Synthetic Polynucleotide
gctccttcca

SEQ ID NO: 942 - DNA, 10 bp, Artificial Sequence
  Synthetic Polynucleotide
aagagcagca

SEQ ID NO: 943 - DNA, 10 bp, Artificial Sequence
  Synthetic Polynucleotide
tgttgtcgtc

SEQ ID NO: 944 - DNA, 10 bp, Artificial Sequence
  Synthetic Polynucleotide
aatatgcggc

SEQ ID NO: 945 - DNA, 10 bp, Artificial Sequence
  Synthetic Polynucleotide
accttgagct

SEQ ID NO: 946 - DNA, 10 bp, Artificial Sequence
  Synthetic Polynucleotide
agttcgacga

SEQ ID NO: 947 - DNA, 10 bp, Artificial Sequence
  Synthetic Polynucleotide
cctcttgctg

SEQ ID NO: 948 - DNA, 10 bp, Artificial Sequence
  Synthetic Polynucleotide
gccatgtgct

SEQ ID NO: 949 - DNA, 10 bp, Artificial Sequence
  Synthetic Polynucleotide
tagcaactga

SEQ ID NO: 950 - DNA, 10 bp, Artificial Sequence
  Synthetic Polynucleotide
ttgcaagtgg

SEQ ID NO: 951 - DNA, 10 bp, Artificial Sequence
  Synthetic Polynucleotide
tctggactgt

SEQ ID NO: 952 - DNA, 10 bp, Artificial Sequence
  Synthetic Polynucleotide
cacaaggcaa

SEQ ID NO: 953 - DNA, 10 bp, Artificial Sequence
  Synthetic Polynucleotide
gctcctgtgt

SEQ ID NO: 954 - DNA, 10 bp, Artificial Sequence
  Synthetic Polynucleotide
aggaactcgc

SEQ ID NO: 955 - DNA, 10 bp, Artificial Sequence
  Synthetic Polynucleotide
gctgccaata

SEQ ID NO: 956 - DNA, 10 bp, Artificial Sequence
  Synthetic Polynucleotide
aaagccctca

SEQ ID NO: 957 - DNA, 10 bp, Artificial Sequence
  Synthetic Polynucleotide
tcgctgctat

SEQ ID NO: 958 - DNA, 10 bp, Artificial Sequence
  Synthetic Polynucleotide
aggtaaggcc

SEQ ID NO: 959 - DNA, 10 bp, Artificial Sequence
  Synthetic Polynucleotide
gctgaactgc

SEQ ID NO: 960 - DNA, 10 bp, Artificial Sequence
  Synthetic Polynucleotide
aacccctgga

SEQ ID NO: 961 - DNA, 10 bp, Artificial Sequence
  Synthetic Polynucleotide
tccgcagcca

SEQ ID NO: 962 - DNA, 10 bp, Artificial Sequence
  Synthetic Polynucleotide
ctgtagctgc

SEQ ID NO: 963 - DNA, 10 bp, Artificial Sequence
  Synthetic Polynucleotide
cagctcctca

SEQ ID NO: 964 - DNA, 10 bp, Artificial Sequence
  Synthetic Polynucleotide
tctacgcaag

SEQ ID NO: 965 - DNA, 10 bp, Artificial Sequence
  Synthetic Polynucleotide
cgcatggccc

SEQ ID NO: 966 - DNA, 10 bp, Artificial Sequence
  Synthetic Polynucleotide
ctcggtgagc

SEQ ID NO: 967 - DNA, 10 bp, Artificial Sequence
  Synthetic Polynucleotide
ccagttccgg

SEQ ID NO: 968 - DNA, 10 bp, Artificial Sequence
  Synthetic Polynucleotide
gcgagggttg

SEQ ID NO: 969 - DNA, 10 bp, Artificial Sequence
  Synthetic Polynucleotide
attccccacg

SEQ ID NO: 970 - DNA, 10 bp, Artificial Sequence
  Synthetic Polynucleotide
gtgtgggacc

SEQ ID NO: 971 - DNA, 10 bp, Artificial Sequence
  Synthetic Polynucleotide
cccaccactt

SEQ ID NO: 972 - DNA, 10 bp, Artificial Sequence
  Synthetic Polynucleotide
cgtgattgga

SEQ ID NO: 973 - DNA, 10 bp, Artificial Sequence
  Synthetic Polynucleotide
cccatctcca

SEQ ID NO: 974 - DNA, 10 bp, Artificial Sequence
  Synthetic Polynucleotide
cagcggtatc

SEQ ID NO: 975 - DNA, 10 bp, Artificial Sequence
  Synthetic Polynucleotide
cggagcatct

SEQ ID NO: 976 - DNA, 10 bp, Artificial Sequence
  Synthetic Polynucleotide
cctgggcatt

SEQ ID NO: 977 - DNA, 10 bp, Artificial Sequence
  Synthetic Polynucleotide
gctcgtcttc

SEQ ID NO: 978 - DNA, 10 bp, Artificial Sequence
  Synthetic Polynucleotide
gcagcggcag

SEQ ID NO: 979 - DNA, 10 bp, Artificial Sequence
  Synthetic Polynucleotide
gcggcaacag

SEQ ID NO: 980 - DNA, 10 bp, Artificial Sequence
  Synthetic Polynucleotide
tggagccacg

SEQ ID NO: 981 - DNA, 10 bp, Artificial Sequence
  Synthetic Polynucleotide
gaggcggagc

SEQ ID NO: 982 - DNA, 10 bp, Artificial Sequence
  Synthetic Polynucleotide
cgcgagagtt

SEQ ID NO: 983 - DNA, 10 bp, Artificial Sequence
  Synthetic Polynucleotide
cagcatggcc

SEQ ID NO: 984 - DNA, 10 bp, Artificial Sequence
  Synthetic Polynucleotide
aggagaccac

SEQ ID NO: 985 - DNA, 10 bp, Artificial Sequence
  Synthetic Polynucleotide
acggagaact

SEQ ID NO: 986 - DNA, 10 bp, Artificial Sequence
  Synthetic Polynucleotide
gacgaaagca

SEQ ID NO: 987 - DNA, 10 bp, Artificial Sequence
  Synthetic Polynucleotide
tagcgaagga

SEQ ID NO: 988 - DNA, 10 bp, Artificial Sequence
  Synthetic Polynucleotide
ttcggtggaa

SEQ ID NO: 989 - DNA, 10 bp, Artificial Sequence
  Synthetic Polynucleotide
acgagtctcc

SEQ ID NO: 990 - DNA, 10 bp, Artificial Sequence
  Synthetic Polynucleotide
gctgctcaag

SEQ ID NO: 991 - DNA, 10 bp, Artificial Sequence
  Synthetic Polynucleotide
aaccccttga

SEQ ID NO: 992 - DNA, 10 bp, Artificial Sequence
  Synthetic Polynucleotide
cggcgactga

SEQ ID NO: 993 - DNA, 10 bp, Artificial Sequence
  Synthetic Polynucleotide
ttcggcactc

SEQ ID NO: 994 - DNA, 10 bp, Artificial Sequence
  Synthetic Polynucleotide
gctgggaaga

SEQ ID NO: 995 - DNA, 10 bp, Artificial Sequence
  Synthetic Polynucleotide
tccaaccact

SEQ ID NO: 996 - DNA, 10 bp, Artificial Sequence
  Synthetic Polynucleotide
gacagcttga

SEQ ID NO: 997 - DNA, 10 bp, Artificial Sequence
  Synthetic Polynucleotide
ggacaaccac

SEQ ID NO: 998 - DNA, 10 bp, Artificial Sequence
  Synthetic Polynucleotide
tgtgtgtgtc

SEQ ID NO: 999 - DNA, 10 bp, Artificial Sequence
  Synthetic Polynucleotide
acgagagtgt

SEQ ID NO: 1000 - DNA, 10 bp, Artificial Sequence
  Synthetic Polynucleotide
tcgggcatga

SEQ ID NO: 1001 - DNA, 10 bp, Artificial Sequence
  Synthetic Polynucleotide
ttcgaggtgt

SEQ ID NO: 1002 - DNA, 10 bp, Artificial Sequence
  Synthetic Polynucleotide
tagaggcgga

SEQ ID NO: 1003 - DNA, 10 bp, Artificial Sequence
  Synthetic Polynucleotide
tcacgacgat

SEQ ID NO: 1004 - DNA, 10 bp, Artificial Sequence
  Synthetic Polynucleotide
tcggagtgtg

SEQ ID NO: 1005 - DNA, 10 bp, Artificial Sequence
  Synthetic Polynucleotide
taccgccacc

SEQ ID NO: 1006 - DNA, 10 bp, Artificial Sequence
  Synthetic Polynucleotide
gatgggttgg

SEQ ID NO: 1007 - DNA, 10 bp, Artificial Sequence
  Synthetic Polynucleotide
agtctgcgta

SEQ ID NO: 1008 - DNA, 10 bp, Artificial Sequence
  Synthetic Polynucleotide
gctggatgta

SEQ ID NO: 1009 - DNA, 10 bp, Artificial Sequence
  Synthetic Polynucleotide
aaccaggtca

SEQ ID NO: 1010 - DNA, 10 bp, Artificial Sequence
  Synthetic Polynucleotide
ggagtttccg

SEQ ID NO: 1011 - DNA, 10 bp, Artificial Sequence
  Synthetic Polynucleotide
caaatcgcca

SEQ ID NO: 1012 - DNA, 10 bp, Artificial Sequence
  Synthetic Polynucleotide
atggggatga

SEQ ID NO: 1013 - DNA, 10 bp, Artificial Sequence
  Synthetic Polynucleotide
gtcaccacac

SEQ ID NO: 1014 - DNA, 10 bp, Artificial Sequence
  Synthetic Polynucleotide
gaggagggtt

SEQ ID NO: 1015 - DNA, 10 bp, Artificial Sequence
  Synthetic Polynucleotide
gaggtttgca

SEQ ID NO: 1016 - DNA, 10 bp, Artificial Sequence
  Synthetic Polynucleotide
gcagaacacc

SEQ ID NO: 1017 - DNA, 10 bp, Artificial Sequence
  Synthetic Polynucleotide
ttttccgggt

SEQ ID NO: 1018 - DNA, 10 bp, Artificial Sequence
  Synthetic Polynucleotide
cagctttcgt

SEQ ID NO: 1019 - DNA, 10 bp, Artificial Sequence
  Synthetic Polynucleotide
gcgctatcct

SEQ ID NO: 1020 - DNA, 10 bp, Artificial Sequence
  Synthetic Polynucleotide
aggtaacgcc

SEQ ID NO: 1021 - DNA, 10 bp, Artificial Sequence
  Synthetic Polynucleotide
catccgagga

SEQ ID NO: 1022 - DNA, 10 bp, Artificial Sequence
  Synthetic Polynucleotide
gttcgcttca

SEQ ID NO: 1023 - DNA, 10 bp, Artificial Sequence
  Synthetic Polynucleotide
ggcagcagaa

SEQ ID NO: 1024 - DNA, 10 bp, Artificial Sequence
  Synthetic Polynucleotide
taggcaggtc

SEQ ID NO: 1025 - DNA, 10 bp, Artificial Sequence
  Synthetic Polynucleotide
ctgtcgccac

SEQ ID NO: 1026 - DNA, 10 bp, Artificial Sequence
  Synthetic Polynucleotide
tggtactggg

SEQ ID NO: 1027 - DNA, 10 bp, Artificial Sequence
  Synthetic Polynucleotide
ccccaatgtc

SEQ ID NO: 1028 - DNA, 10 bp, Artificial Sequence
  Synthetic Polynucleotide
tgggcacgtt

SEQ ID NO: 1029 - DNA, 10 bp, Artificial Sequence
  Synthetic Polynucleotide
gcacagacta

SEQ ID NO: 1030 - DNA, 10 bp, Artificial Sequence
  Synthetic Polynucleotide
gaggcacaag

SEQ ID NO: 1031 - DNA, 10 bp, Artificial Sequence
  Synthetic Polynucleotide
tcctccttca

SEQ ID NO: 1032 - DNA, 10 bp, Artificial Sequence
  Synthetic Polynucleotide
gtggtcctga

SEQ ID NO: 1033 - DNA, 10 bp, Artificial Sequence
  Synthetic Polynucleotide
atcgccactg

SEQ ID NO: 1034 - DNA, 10 bp, Artificial Sequence
  Synthetic Polynucleotide
cgcttgacag

SEQ ID NO: 1035 - DNA, 10 bp, Artificial Sequence
  Synthetic Polynucleotide
cagcacagag

SEQ ID NO: 1036 - DNA, 10 bp, Artificial Sequence
  Synthetic Polynucleotide
ggttgccgca

SEQ ID NO: 1037 - DNA, 10 bp, Artificial Sequence
  Synthetic Polynucleotide
aacaggagct

SEQ ID NO: 1038 - DNA, 10 bp, Artificial Sequence
  Synthetic Polynucleotide
gctgcttgga

SEQ ID NO: 1039 - DNA, 10 bp, Artificial Sequence
  Synthetic Polynucleotide
tttccgcatc

SEQ ID NO: 1040 - DNA, 10 bp, Artificial Sequence
  Synthetic Polynucleotide
tgcacagagt

SEQ ID NO: 1041 - DNA, 10 bp, Artificial Sequence
  Synthetic Polynucleotide
gcgcattttg

SEQ ID NO: 1042 - DNA, 10 bp, Artificial Sequence
  Synthetic Polynucleotide
ggaggttgtg

SEQ ID NO: 1043 - DNA, 10 bp, Artificial Sequence
  Synthetic Polynucleotide
ctgcacgagc

SEQ ID NO: 1044 - DNA, 10 bp, Artificial Sequence
  Synthetic Polynucleotide
tgccaaacgc

SEQ ID NO: 1045 - DNA, 10 bp, Artificial Sequence
  Synthetic Polynucleotide
atctggtccc

SEQ ID NO: 1046 - DNA, 10 bp, Artificial Sequence
  Synthetic Polynucleotide
ggaccttggt

SEQ ID NO: 1047 - DNA, 10 bp, Artificial Sequence
  Synthetic Polynucleotide
cggttgtggg

SEQ ID NO: 1048 - DNA, 10 bp, Artificial Sequence
  Synthetic Polynucleotide
agtgtggtcg

SEQ ID NO: 1049 - DNA, 10 bp, Artificial Sequence
  Synthetic Polynucleotide
tgtgatgccc

SEQ ID NO: 1050 - DNA, 10 bp, Artificial Sequence
  Synthetic Polynucleotide
gacaggacga

SEQ ID NO: 1051 - DNA, 10 bp, Artificial Sequence
  Synthetic Polynucleotide
cagcttgaca

SEQ ID NO: 1052 - DNA, 10 bp, Artificial Sequence
  Synthetic Polynucleotide
atgggttggg

SEQ ID NO: 1053 - DNA, 10 bp, Artificial Sequence
  Synthetic Polynucleotide
gcatcaccac

SEQ ID NO: 1054 - DNA, 10 bp, Artificial Sequence
  Synthetic Polynucleotide
gcaccaccaa

SEQ ID NO: 1055 - DNA, 10 bp, Artificial Sequence
  Synthetic Polynucleotide
tccacacacc

SEQ ID NO: 1056 - DNA, 10 bp, Artificial Sequence
  Synthetic Polynucleotide
gcttacgcaa

SEQ ID NO: 1057 - DNA, 10 bp, Artificial Sequence
  Synthetic Polynucleotide
accacctggc

SEQ ID NO: 1058 - DNA, 10 bp, Artificial Sequence
  Synthetic Polynucleotide
gcttcaccac

SEQ ID NO: 1059 - DNA, 10 bp, Artificial Sequence
  Synthetic Polynucleotide
ctgtggctgt

SEQ ID NO: 1060 - DNA, 10 bp, Artificial Sequence
  Synthetic Polynucleotide
tcatggcacc

SEQ ID NO: 1061 - DNA, 10 bp, Artificial Sequence
  Synthetic Polynucleotide
ggtcgttcta

SEQ ID NO: 1062 - DNA, 10 bp, Artificial Sequence
  Synthetic Polynucleotide
ttcgtcgcaa

SEQ ID NO: 1063 - DNA, 10 bp, Artificial Sequence
  Synthetic Polynucleotide
ccgtgcattt

SEQ ID NO: 1064 - DNA, 10 bp, Artificial Sequence
  Synthetic Polynucleotide
gccccacaaa

SEQ ID NO: 1065 - DNA, 10 bp, Artificial Sequence
  Synthetic Polynucleotide
gggtgcttgc

SEQ ID NO: 1066 - DNA, 10 bp, Artificial Sequence
  Synthetic Polynucleotide
gcagcgaatc

SEQ ID NO: 1067 - DNA, 10 bp, Artificial Sequence
  Synthetic Polynucleotide
tgccttcggg

SEQ ID NO: 1068 - DNA, 10 bp, Artificial Sequence
  Synthetic Polynucleotide
cgatgaccag

SEQ ID NO: 1069 - DNA, 10 bp, Artificial Sequence
  Synthetic Polynucleotide
catcgcctac

SEQ ID NO: 1070 - DNA, 10 bp, Artificial Sequence
  Synthetic Polynucleotide
gatctcgtcg

SEQ ID NO: 1071 - DNA, 10 bp, Artificial Sequence
  Synthetic Polynucleotide
gctggcaacc

SEQ ID NO: 1072 - DNA, 10 bp, Artificial Sequence
  Synthetic Polynucleotide
cgtgatgtcc

SEQ ID NO: 1073 - DNA, 10 bp, Artificial Sequence
  Synthetic Polynucleotide
ccaccatcgc

SEQ ID NO: 1074 - DNA, 10 bp, Artificial Sequence
  Synthetic Polynucleotide
tcatctccgc

SEQ ID NO: 1075 - DNA, 10 bp, Artificial Sequence
  Synthetic Polynucleotide
gttcatcgcg

SEQ ID NO: 1076 - DNA, 10 bp, Artificial Sequence
  Synthetic Polynucleotide
cacactgacg

SEQ ID NO: 1077 - DNA, 10 bp, Artificial Sequence
  Synthetic Polynucleotide
gcgttgggcc

SEQ ID NO: 1078 - DNA, 10 bp, Artificial Sequence
  Synthetic Polynucleotide
gcttcagcat

SEQ ID NO: 1079 - DNA, 10 bp, Artificial Sequence
  Synthetic Polynucleotide
gtaccgccgg

SEQ ID NO: 1080 - DNA, 10 bp, Artificial Sequence
  Synthetic Polynucleotide
agctgttcct

SEQ ID NO: 1081 - DNA, 10 bp, Artificial Sequence
  Synthetic Polynucleotide
tggttaccca

SEQ ID NO: 1082 - DNA, 10 bp, Artificial Sequence
  Synthetic Polynucleotide
gattgccaga

SEQ ID NO: 1083 - DNA, 10 bp, Artificial Sequence
  Synthetic Polynucleotide
atgagcgacg

SEQ ID NO: 1084 - DNA, 10 bp, Artificial Sequence
  Synthetic Polynucleotide
tctgttgggt

SEQ ID NO: 1085 - DNA, 10 bp, Artificial Sequence
  Synthetic Polynucleotide
gcagcaaaca

SEQ ID NO: 1086 - DNA, 10 bp, Artificial Sequence
  Synthetic Polynucleotide
aagtgagccc

SEQ ID NO: 1087 - DNA, 10 bp, Artificial Sequence
  Synthetic Polynucleotide
ctcctttggc

SEQ ID NO: 1088 - DNA, 10 bp, Artificial Sequence
  Synthetic Polynucleotide
tagcgtcaaa

SEQ ID NO: 1089 - DNA, 10 bp, Artificial Sequence
  Synthetic Polynucleotide
gcgatgccca

SEQ ID NO: 1090 - DNA, 10 bp, Artificial Sequence
  Synthetic Polynucleotide
cagttgggtc

SEQ ID NO: 1091 - DNA, 10 bp, Artificial Sequence
  Synthetic Polynucleotide
cgattcgaca

SEQ ID NO: 1092 - DNA, 10 bp, Artificial Sequence
  Synthetic Polynucleotide
tcaccagcga

SEQ ID NO: 1093 - DNA, 10 bp, Artificial Sequence
  Synthetic Polynucleotide
aggctacccc

SEQ ID NO: 1094 - DNA, 10 bp, Artificial Sequence
  Synthetic Polynucleotide
ctgccaatgc

SEQ ID NO: 1095 - DNA, 10 bp, Artificial Sequence
  Synthetic Polynucleotide
tctcggtaga

SEQ ID NO: 1096 - DNA, 10 bp, Artificial Sequence
  Synthetic Polynucleotide
ctctcgatgc

SEQ ID NO: 1097 - DNA, 10 bp, Artificial Sequence
  Synthetic Polynucleotide
aagacgtgct

SEQ ID NO: 1098 - DNA, 10 bp, Artificial Sequence
  Synthetic Polynucleotide
cacgaaggtc

SEQ ID NO: 1099 - DNA, 10 bp, Artificial Sequence
  Synthetic Polynucleotide
aggtggtctc

SEQ ID NO: 1100 - DNA, 10 bp, Artificial Sequence
  Synthetic Polynucleotide
tctggctgag

SEQ ID NO: 1101 - DNA, 10 bp, Artificial Sequence
  Synthetic Polynucleotide
acattggctg

SEQ ID NO: 1102 - DNA, 10 bp, Artificial Sequence
  Synthetic Polynucleotide
tggagttgct

SEQ ID NO: 1103 - DNA, 10 bp, Artificial Sequence
  Synthetic Polynucleotide
tggcaatcag

SEQ ID NO: 1104 - DNA, 10 bp, Artificial Sequence
  Synthetic Polynucleotide
gcatttgggt

SEQ ID NO: 1105 - DNA, 10 bp, Artificial Sequence
  Synthetic Polynucleotide
atctccacga

SEQ ID NO: 1106 - DNA, 10 bp, Artificial Sequence
  Synthetic Polynucleotide
ggggtctcct

SEQ ID NO: 1107 - DNA, 10 bp, Artificial Sequence
  Synthetic Polynucleotide
aagtcaggcc

SEQ ID NO: 1108 - DNA, 10 bp, Artificial Sequence
  Synthetic Polynucleotide
ggcagtacca

SEQ ID NO: 1109 - DNA, 10 bp, Artificial Sequence
  Synthetic Polynucleotide
tggcgttagt

SEQ ID NO: 1110 - DNA, 10 bp, Artificial Sequence
  Synthetic Polynucleotide
cagggcattc

SEQ ID NO: 1111 - DNA, 10 bp, Artificial Sequence
  Synthetic Polynucleotide
gaacaagccc

SEQ ID NO: 1112 - DNA, 10 bp, Artificial Sequence
  Synthetic Polynucleotide
tccatgtgcc

SEQ ID NO: 1113 - DNA, 10 bp, Artificial Sequence
  Synthetic Polynucleotide
gtggacgagg

SEQ ID NO: 1114 - DNA, 10 bp, Artificial Sequence
  Synthetic Polynucleotide
ccagccacat

SEQ ID NO: 1115 - DNA, 10 bp, Artificial Sequence
  Synthetic Polynucleotide
tggcaatgac

SEQ ID NO: 1116 - DNA, 10 bp, Artificial Sequence
  Synthetic Polynucleotide
ccagtcctcc

SEQ ID NO: 1117 - DNA, 10 bp, Artificial Sequence
  Synthetic Polynucleotide
agacggtgct

SEQ ID NO: 1118 - DNA, 10 bp, Artificial Sequence
  Synthetic Polynucleotide
cacccgaagg

SEQ ID NO: 1119 - DNA, 10 bp, Artificial Sequence
  Synthetic Polynucleotide
taaatcccgg

SEQ ID NO: 1120 - DNA, 10 bp, Artificial Sequence
  Synthetic Polynucleotide
tcaccacaca

SEQ ID NO: 1121 - DNA, 10 bp, Artificial Sequence
  Synthetic Polynucleotide
gctgggacac

SEQ ID NO: 1122 - DNA, 10 bp, Artificial Sequence
  Synthetic Polynucleotide
taggggcaag

SEQ ID NO: 1123 - DNA, 10 bp, Artificial Sequence
  Synthetic Polynucleotide
ggagaggtgg

SEQ ID NO: 1124 - DNA, 10 bp, Artificial Sequence
  Synthetic Polynucleotide
atccacaccc

SEQ ID NO: 1125 - DNA, 10 bp, Artificial Sequence
  Synthetic Polynucleotide
tctgctccca

SEQ ID NO: 1126 - DNA, 10 bp, Artificial Sequence
  Synthetic Polynucleotide
tgtccaaggc

SEQ ID NO: 1127 - DNA, 10 bp, Artificial Sequence
  Synthetic Polynucleotide
gcaaaggaga

SEQ ID NO: 1128 - DNA, 10 bp, Artificial Sequence
  Synthetic Polynucleotide
tccaatgtgc

SEQ ID NO: 1129 - DNA, 10 bp, Artificial Sequence
  Synthetic Polynucleotide
tgtgtcatgc

SEQ ID NO: 1130 - DNA, 10 bp, Artificial Sequence
  Synthetic Polynucleotide
tgtcccatcc

SEQ ID NO: 1131 - DNA, 10 bp, Artificial Sequence
  Synthetic Polynucleotide
acatgtggct

SEQ ID NO: 1132 - DNA, 10 bp, Artificial Sequence
  Synthetic Polynucleotide
atcgtcacca

SEQ ID NO: 1133 - DNA, 10 bp, Artificial Sequence
  Synthetic Polynucleotide
ttctgggcga

SEQ ID NO: 1134 - DNA, 10 bp, Artificial Sequence
  Synthetic Polynucleotide
tggtcatcca

SEQ ID NO: 1135 - DNA, 10 bp, Artificial Sequence
  Synthetic Polynucleotide
agtgggaaga

SEQ ID NO: 1136 - DNA, 10 bp, Artificial Sequence
  Synthetic Polynucleotide
taggacctgt

SEQ ID NO: 1137 - DNA, 10 bp, Artificial Sequence
  Synthetic Polynucleotide
ggcttggtta

SEQ ID NO: 1138 - DNA, 10 bp, Artificial Sequence
  Synthetic Polynucleotide
acgatgctgc

SEQ ID NO: 1139 - DNA, 10 bp, Artificial Sequence
  Synthetic Polynucleotide
aacctggagg

SEQ ID NO: 1140 - DNA, 10 bp, Artificial Sequence
  Synthetic Polynucleotide
aagtggcagc

SEQ ID NO: 1141 - DNA, 10 bp, Artificial Sequence
  Synthetic Polynucleotide
aatgccaggt

SEQ ID NO: 1142 - DNA, 10 bp, Artificial Sequence
  Synthetic Polynucleotide
tgagcacctc

SEQ ID NO: 1143 - DNA, 10 bp, Artificial Sequence
  Synthetic Polynucleotide
ttgcccaaag

SEQ ID NO: 1144 - DNA, 10 bp, Artificial Sequence
  Synthetic Polynucleotide
acttcctcga

SEQ ID NO: 1145 - DNA, 10 bp, Artificial Sequence
  Synthetic Polynucleotide
acactcccga

SEQ ID NO: 1146 - DNA, 10 bp, Artificial Sequence
  Synthetic Polynucleotide
ggctttgagg

SEQ ID NO: 1147 - DNA, 10 bp, Artificial Sequence
  Synthetic Polynucleotide
tgccctctca

SEQ ID NO: 1148 - DNA, 10 bp, Artificial Sequence
  Synthetic Polynucleotide
ccgtccctgt

SEQ ID NO: 1149 - DNA, 10 bp, Artificial Sequence
  Synthetic Polynucleotide
tggacgagta

SEQ ID NO: 1150 - DNA, 10 bp, Artificial Sequence
  Synthetic Polynucleotide
acccagcctt

SEQ ID NO: 1151 - DNA, 10 bp, Artificial Sequence
  Synthetic Polynucleotide
gcagcctttg

SEQ ID NO: 1152 - DNA, 10 bp, Artificial Sequence
  Synthetic Polynucleotide
cagtgttggc

SEQ ID NO: 1153 - DNA, 10 bp, Artificial Sequence
  Synthetic Polynucleotide
tgggtcaaga

SEQ ID NO: 1154 - DNA, 10 bp, Artificial Sequence
  Synthetic Polynucleotide
tcgcagttga

SEQ ID NO: 1155 - DNA, 10 bp, Artificial Sequence
  Synthetic Polynucleotide
ccaccatcga

SEQ ID NO: 1156 - DNA, 10 bp, Artificial Sequence
  Synthetic Polynucleotide
tcgtttgtgt

SEQ ID NO: 1157 - DNA, 10 bp, Artificial Sequence
  Synthetic Polynucleotide
caacaggcaa

SEQ ID NO: 1158 - DNA, 10 bp, Artificial Sequence
  Synthetic Polynucleotide
ggtccctcgc

SEQ ID NO: 1159 - DNA, 10 bp, Artificial Sequence
  Synthetic Polynucleotide
tcgccttggt

SEQ ID NO: 1160 - DNA, 10 bp, Artificial Sequence
  Synthetic Polynucleotide
tgtgacccct

SEQ ID NO: 1161 - DNA, 10 bp, Artificial Sequence
  Synthetic Polynucleotide
ggtgagaggc

SEQ ID NO: 1162 - DNA, 10 bp, Artificial Sequence
  Synthetic Polynucleotide
aggtagccgc

SEQ ID NO: 1163 - DNA, 10 bp, Artificial Sequence
  Synthetic Polynucleotide
ccttcgacca

SEQ ID NO: 1164 - DNA, 10 bp, Artificial Sequence
  Synthetic Polynucleotide
acccgcagaa

SEQ ID NO: 1165 - DNA, 10 bp, Artificial Sequence
  Synthetic Polynucleotide
acacggaatg

SEQ ID NO: 1166 - DNA, 10 bp, Artificial Sequence
  Synthetic Polynucleotide
catcagggca

SEQ ID NO: 1167 - DNA, 10 bp, Artificial Sequence
  Synthetic Polynucleotide
ggtcaagcgc

SEQ ID NO: 1168 - DNA, 10 bp, Artificial Sequence
  Synthetic Polynucleotide
tcacctcagt

SEQ ID NO: 1169 - DNA, 10 bp, Artificial Sequence
  Synthetic Polynucleotide
tgggctttca

SEQ ID NO: 1170 - DNA, 10 bp, Artificial Sequence
  Synthetic Polynucleotide
gtgggaggct

SEQ ID NO: 1171 - DNA, 10 bp, Artificial Sequence
  Synthetic Polynucleotide
tttgctgcct

SEQ ID NO: 1172 - DNA, 10 bp, Artificial Sequence
  Synthetic Polynucleotide
ctcgccttgg

SEQ ID NO: 1173 - DNA, 10 bp, Artificial Sequence
  Synthetic Polynucleotide
tgacgagagc

SEQ ID NO: 1174 - DNA, 10 bp, Artificial Sequence
  Synthetic Polynucleotide
tcaggcatga

SEQ ID NO: 1175 - DNA, 10 bp, Artificial Sequence
  Synthetic Polynucleotide
tcgcagaagg

SEQ ID NO: 1176 - DNA, 10 bp, Artificial Sequence
  Synthetic Polynucleotide
aggtccagac

SEQ ID NO: 1177 - DNA, 10 bp, Artificial Sequence
  Synthetic Polynucleotide
cttgggaggc

SEQ ID NO: 1178 - DNA, 10 bp, Artificial Sequence
  Synthetic Polynucleotide
tccagcacga

SEQ ID NO: 1179 - DNA, 10 bp, Artificial Sequence
  Synthetic Polynucleotide
tgggtgatgg

SEQ ID NO: 1180 - DNA, 10 bp, Artificial Sequence
  Synthetic Polynucleotide
acagggacgg

SEQ ID NO: 1181 - DNA, 10 bp, Artificial Sequence
  Synthetic Polynucleotide
ggcttcaccg

SEQ ID NO: 1182 - DNA, 10 bp, Artificial Sequence
  Synthetic Polynucleotide
aagctggtca

SEQ ID NO: 1183 - DNA, 10 bp, Artificial Sequence
  Synthetic Polynucleotide
ttgtttgggc

SEQ ID NO: 1184 - DNA, 10 bp, Artificial Sequence
  Synthetic Polynucleotide
cacaatgcga

SEQ ID NO: 1185 - DNA, 10 bp, Artificial Sequence
  Synthetic Polynucleotide
ggcagttgga

SEQ ID NO: 1186 - DNA, 10 bp, Artificial Sequence
  Synthetic Polynucleotide
cacagcaact

SEQ ID NO: 1187 - DNA, 10 bp, Artificial Sequence
  Synthetic Polynucleotide
tggcttggtg

SEQ ID NO: 1188 - DNA, 10 bp, Artificial Sequence
  Synthetic Polynucleotide
aagctcacct

SEQ ID NO: 1189 - DNA, 10 bp, Artificial Sequence
  Synthetic Polynucleotide
gcttcaccag

SEQ ID NO: 1190 - DNA, 10 bp, Artificial Sequence
  Synthetic Polynucleotide
caactctgca

SEQ ID NO: 1191 - DNA, 10 bp, Artificial Sequence
  Synthetic Polynucleotide
gccacagttg

SEQ ID NO: 1192 - DNA, 10 bp, Artificial Sequence
  Synthetic Polynucleotide
agagcactgc

SEQ ID NO: 1193 - DNA, 10 bp, Artificial Sequence
  Synthetic Polynucleotide
agtgggcatg

SEQ ID NO: 1194 - DNA, 10 bp, Artificial Sequence
  Synthetic Polynucleotide
cgcacacaca

SEQ ID NO: 1195 - DNA, 10 bp, Artificial Sequence
  Synthetic Polynucleotide
ggcacggtaa

SEQ ID NO: 1196 - DNA, 10 bp, Artificial Sequence
  Synthetic Polynucleotide
caagcgtctg

SEQ ID NO: 1197 - DNA, 10 bp, Artificial Sequence
  Synthetic Polynucleotide
tctcccctct

SEQ ID NO: 1198 - DNA, 10 bp, Artificial Sequence
  Synthetic Polynucleotide
tgccgtctcg

SEQ ID NO: 1199 - DNA, 10 bp, Artificial Sequence
  Synthetic Polynucleotide
cagaggcgta

SEQ ID NO: 1200 - DNA, 10 bp, Artificial Sequence
  Synthetic Polynucleotide
cgtcacatgg

SEQ ID NO: 1201 - DNA, 10 bp, Artificial Sequence
  Synthetic Polynucleotide
gctactgcct

SEQ ID NO: 1202 - DNA, 10 bp, Artificial Sequence
  Synthetic Polynucleotide
aggtggcaaa

SEQ ID NO: 1203 - DNA, 10 bp, Artificial Sequence
  Synthetic Polynucleotide
tacatgggcc

SEQ ID NO: 1204 - DNA, 10 bp, Artificial Sequence
  Synthetic Polynucleotide
ccggatggcc

SEQ ID NO: 1205 - DNA, 10 bp, Artificial Sequence
  Synthetic Polynucleotide
gcaatccagg

SEQ ID NO: 1206 - DNA, 10 bp, Artificial Sequence
  Synthetic Polynucleotide
cccctgtgcg

SEQ ID NO: 1207 - DNA, 10 bp, Artificial Sequence
  Synthetic Polynucleotide
acgaagcgat

SEQ ID NO: 1208 - DNA, 10 bp, Artificial Sequence
  Synthetic Polynucleotide
taccacttcg

SEQ ID NO: 1209 - DNA, 10 bp, Artificial Sequence
  Synthetic Polynucleotide
ggctgtcgaa

SEQ ID NO: 1210 - DNA, 10 bp, Artificial Sequence
  Synthetic Polynucleotide
tgtgggatcc

SEQ ID NO: 1211 - DNA, 10 bp, Artificial Sequence
  Synthetic Polynucleotide
gcgttcttgc

SEQ ID NO: 1212 - DNA, 10 bp, Artificial Sequence
  Synthetic Polynucleotide
tcaaacgtgt

SEQ ID NO: 1213 - DNA, 10 bp, Artificial Sequence
  Synthetic Polynucleotide
acgggaagcc

SEQ ID NO: 1214 - DNA, 10 bp, Artificial Sequence
  Synthetic Polynucleotide
tgcagtgatg

SEQ ID NO: 1215 - DNA, 10 bp, Artificial Sequence
  Synthetic Polynucleotide
acatctgcgg

SEQ ID NO: 1216 - DNA, 10 bp, Artificial Sequence
  Synthetic Polynucleotide
atgtcgtcga

SEQ ID NO: 1217 - DNA, 10 bp, Artificial Sequence
  Synthetic Polynucleotide
gccaagttca

SEQ ID NO: 1218 - DNA, 10 bp, Artificial Sequence
  Synthetic Polynucleotide
tcaattgggc

SEQ ID NO: 1219 - DNA, 10 bp, Artificial Sequence
  Synthetic Polynucleotide
cggatggccg

SEQ ID NO: 1220 - DNA, 10 bp, Artificial Sequence
  Synthetic Polynucleotide
ggacaccagg

SEQ ID NO: 1221 - DNA, 10 bp, Artificial Sequence
  Synthetic Polynucleotide
caatgtgggc

SEQ ID NO: 1222 - DNA, 10 bp, Artificial Sequence
  Synthetic Polynucleotide
ggcgttcttg

SEQ ID NO: 1223 - DNA, 10 bp, Artificial Sequence
  Synthetic Polynucleotide
ggtgcaagga

SEQ ID NO: 1224 - DNA, 10 bp, Artificial Sequence
  Synthetic Polynucleotide
catttgccca

SEQ ID NO: 1225 - DNA, 10 bp, Artificial Sequence
  Synthetic Polynucleotide
ttgtagccca

SEQ ID NO: 1226 - DNA, 10 bp, Artificial Sequence
  Synthetic Polynucleotide
gcacgacaca

SEQ ID NO: 1227 - DNA, 10 bp, Artificial Sequence
  Synthetic Polynucleotide
ccttgcatcc

SEQ ID NO: 1228 - DNA, 10 bp, Artificial Sequence
  Synthetic Polynucleotide
atcgaccaca

SEQ ID NO: 1229 - DNA, 10 bp, Artificial Sequence
  Synthetic Polynucleotide
tcgactctgt

SEQ ID NO: 1230 - DNA, 10 bp, Artificial Sequence
  Synthetic Polynucleotide
ggcaacaggt

SEQ ID NO: 1231 - DNA, 10 bp, Artificial Sequence
  Synthetic Polynucleotide
ttgaggccca

SEQ ID NO: 1232 - DNA, 10 bp, Artificial Sequence
  Synthetic Polynucleotide
tccttggaga

SEQ ID NO: 1233 - DNA, 10 bp, Artificial Sequence
  Synthetic Polynucleotide
taagcgatgt

SEQ ID NO: 1234 - DNA, 10 bp, Artificial Sequence
  Synthetic Polynucleotide
accctggaca

SEQ ID NO: 1235 - DNA, 10 bp, Artificial Sequence
  Synthetic Polynucleotide
tccagaagga

SEQ ID NO: 1236 - DNA, 10 bp, Artificial Sequence
  Synthetic Polynucleotide
ttcaccacga

SEQ ID NO: 1237 - DNA, 10 bp, Artificial Sequence
  Synthetic Polynucleotide
cggaggagct

SEQ ID NO: 1238 - DNA, 10 bp, Artificial Sequence
  Synthetic Polynucleotide
accatgtgca

SEQ ID NO: 1239 - DNA, 10 bp, Artificial Sequence
  Synthetic Polynucleotide
cggatggccg

SEQ ID NO: 1240 - DNA, 10 bp, Artificial Sequence
  Synthetic Polynucleotide
agaatggcgt

SEQ ID NO: 1241 - DNA, 10 bp, Artificial Sequence
  Synthetic Polynucleotide
caggttgtgg

SEQ ID NO: 1242 - DNA, 10 bp, Artificial Sequence
  Synthetic Polynucleotide
gcaccaacag

SEQ ID NO: 1243 - DNA, 10 bp, Artificial Sequence
  Synthetic Polynucleotide
gcccatgact

SEQ ID NO: 1244 - DNA, 10 bp, Artificial Sequence
  Synthetic Polynucleotide
gatgcggact

SEQ ID NO: 1245 - DNA, 10 bp, Artificial Sequence
  Synthetic Polynucleotide
aggcgtttta

SEQ ID NO: 1246 - DNA, 10 bp, Artificial Sequence
  Synthetic Polynucleotide
aggccctgct

SEQ ID NO: 1247 - DNA, 10 bp, Artificial Sequence
  Synthetic Polynucleotide
tgcctaagcg

SEQ ID NO: 1248 - DNA, 10 bp, Artificial Sequence
  Synthetic Polynucleotide
ttccatccga

SEQ ID NO: 1249 - DNA, 10 bp, Artificial Sequence
  Synthetic Polynucleotide
gcccacatgg

SEQ ID NO: 1250 - DNA, 10 bp, Artificial Sequence
  Synthetic Polynucleotide
ccggagccat

SEQ ID NO: 1251 - DNA, 10 bp, Artificial Sequence
  Synthetic Polynucleotide
ttcgaccgtg

SEQ ID NO: 1252 - DNA, 10 bp, Artificial Sequence
  Synthetic Polynucleotide
ggcccaagcc

SEQ ID NO: 1253 - DNA, 10 bp, Artificial Sequence
  Synthetic Polynucleotide
acccgattgt

SEQ ID NO: 1254 - DNA, 10 bp, Artificial Sequence
  Synthetic Polynucleotide
aagactgcca

SEQ ID NO: 1255 - DNA, 10 bp, Artificial Sequence
  Synthetic Polynucleotide
taggtccagg

SEQ ID NO: 1256 - DNA, 10 bp, Artificial Sequence
  Synthetic Polynucleotide
caagctgcac

SEQ ID NO: 1257 - DNA, 10 bp, Artificial Sequence
  Synthetic Polynucleotide
gccgatactg

SEQ ID NO: 1258 - DNA, 10 bp, Artificial Sequence
  Synthetic Polynucleotide
tatcacgccc

SEQ ID NO: 1259 - DNA, 10 bp, Artificial Sequence
  Synthetic Polynucleotide
ggtcgtggct

SEQ ID NO: 1260 - DNA, 10 bp, Artificial Sequence
  Synthetic Polynucleotide
caacggggta

SEQ ID NO: 1261 - DNA, 10 bp, Artificial Sequence
  Synthetic Polynucleotide
ttcccatccc

SEQ ID NO: 1262 - DNA, 10 bp, Artificial Sequence
  Synthetic Polynucleotide
ggagaggggt

SEQ ID NO: 1263 - DNA, 10 bp, Artificial Sequence
  Synthetic Polynucleotide
atcctgctga

SEQ ID NO: 1264 - DNA, 10 bp, Artificial Sequence
  Synthetic Polynucleotide
gcctacagcc

SEQ ID NO: 1265 - DNA, 10 bp, Artificial Sequence
  Synthetic Polynucleotide
catggctgct

SEQ ID NO: 1266 - DNA, 10 bp, Artificial Sequence
  Synthetic Polynucleotide
accacagcat

SEQ ID NO: 1267 - DNA, 10 bp, Artificial Sequence
  Synthetic Polynucleotide
tggaggccca

SEQ ID NO: 1268 - DNA, 10 bp, Artificial Sequence
  Synthetic Polynucleotide
caacaccagc

SEQ ID NO: 1269 - DNA, 10 bp, Artificial Sequence
  Synthetic Polynucleotide
tatctgcgtg

SEQ ID NO: 1270 - DNA, 10 bp, Artificial Sequence
  Synthetic Polynucleotide
gacggggacg

SEQ ID NO: 1271 - DNA, 10 bp, Artificial Sequence
  Synthetic Polynucleotide
gtcctcgtcc

SEQ ID NO: 1272 - DNA, 10 bp, Artificial Sequence
  Synthetic Polynucleotide
ccaccaccac

SEQ ID NO: 1273 - DNA, 10 bp, Artificial Sequence
  Synthetic Polynucleotide
ggtggtggtg

SEQ ID NO: 1274 - DNA, 10 bp, Artificial Sequence
  Synthetic Polynucleotide
agcctgggag

SEQ ID NO: 1275 - DNA, 10 bp, Artificial Sequence
  Synthetic Polynucleotide
ctctacggcg

SEQ ID NO: 1276 - DNA, 10 bp, Artificial Sequence
  Synthetic Polynucleotide
cctgctgggc

SEQ ID NO: 1277 - DNA, 10 bp, Artificial Sequence
  Synthetic Polynucleotide
ccagcagcgc

SEQ ID NO: 1278 - DNA, 10 bp, Artificial Sequence
  Synthetic Polynucleotide
ggcctgggtg

SEQ ID NO: 1279 - DNA, 10 bp, Artificial Sequence
  Synthetic Polynucleotide
ctggagaacg

SEQ ID NO: 1280 - DNA, 10 bp, Artificial Sequence
  Synthetic Polynucleotide
gttcgacgcc

SEQ ID NO: 1281 - DNA, 10 bp, Artificial Sequence
  Synthetic Polynucleotide
agctcctcct

SEQ ID NO: 1282 - DNA, 10 bp, Artificial Sequence
  Synthetic Polynucleotide
acttgtgcca

SEQ ID NO: 1283 - DNA, 10 bp, Artificial Sequence
  Synthetic Polynucleotide
gtggaatggg

SEQ ID NO: 1284 - DNA, 10 bp, Artificial Sequence
  Synthetic Polynucleotide
gccatcgctt

SEQ ID NO: 1285 - DNA, 10 bp, Artificial Sequence
  Synthetic Polynucleotide
ggccacggtt

SEQ ID NO: 1286 - DNA, 10 bp, Artificial Sequence
  Synthetic Polynucleotide
aaacatgggc

SEQ ID NO: 1287 - DNA, 10 bp, Artificial Sequence
  Synthetic Polynucleotide
ttgtcatgcg

SEQ ID NO: 1288 - DNA, 10 bp, Artificial Sequence
  Synthetic Polynucleotide
agtctgcggt

SEQ ID NO: 1289 - DNA, 10 bp, Artificial Sequence
  Synthetic Polynucleotide
cgtgttcgct

SEQ ID NO: 1290 - DNA, 10 bp, Artificial Sequence
  Synthetic Polynucleotide
cgatggctcc

SEQ ID NO: 1291 - DNA, 10 bp, Artificial Sequence
  Synthetic Polynucleotide
gagtggacca

SEQ ID NO: 1292 - DNA, 10 bp, Artificial Sequence
  Synthetic Polynucleotide
ggccaccacc

SEQ ID NO: 1293 - DNA, 10 bp, Artificial Sequence
  Synthetic Polynucleotide
catccgctac

SEQ ID NO: 1294 - DNA, 10 bp, Artificial Sequence
  Synthetic Polynucleotide
actcacccac

SEQ ID NO: 1295 - DNA, 10 bp, Artificial Sequence
  Synthetic Polynucleotide
ggcgaagaag

SEQ ID NO: 1296 - DNA, 10 bp, Artificial Sequence
  Synthetic Polynucleotide
acgccagtaa

SEQ ID NO: 1297 - DNA, 10 bp, Artificial Sequence
  Synthetic Polynucleotide
gtggtcgtgg

SEQ ID NO: 1298 - DNA, 10 bp, Artificial Sequence
  Synthetic Polynucleotide
aaccgccacc

SEQ ID NO: 1299 - DNA, 10 bp, Artificial Sequence
  Synthetic Polynucleotide
agggtgacga

SEQ ID NO: 1300 - DNA, 10 bp, Artificial Sequence
  Synthetic Polynucleotide
aacgtagcgt

SEQ ID NO: 1301 - DNA, 10 bp, Artificial Sequence
  Synthetic Polynucleotide
tcgggattgt

SEQ ID NO: 1302 - DNA, 10 bp, Artificial Sequence
  Synthetic Polynucleotide
ccgaggaaca

SEQ ID NO: 1303 - DNA, 10 bp, Artificial Sequence
  Synthetic Polynucleotide
cgcgtcgggt

SEQ ID NO: 1304 - DNA, 10 bp, Artificial Sequence
  Synthetic Polynucleotide
gaagtcgccg

SEQ ID NO: 1305 - DNA, 10 bp, Artificial Sequence
  Synthetic Polynucleotide
cgcgatggtg

SEQ ID NO: 1306 - DNA, 10 bp, Artificial Sequence
  Synthetic Polynucleotide
tctgctgttc

SEQ ID NO: 1307 - DNA, 10 bp, Artificial Sequence
  Synthetic Polynucleotide
agtcctcacg

SEQ ID NO: 1308 - DNA, 10 bp, Artificial Sequence
  Synthetic Polynucleotide
tgaagccctg

SEQ ID NO: 1309 - DNA, 10 bp, Artificial Sequence
  Synthetic Polynucleotide
gcgagcgata

SEQ ID NO: 1310 - DNA, 10 bp, Artificial Sequence
  Synthetic Polynucleotide
acacggggag

SEQ ID NO: 1311 - DNA, 10 bp, Artificial Sequence
  Synthetic Polynucleotide
ccttggtgct

SEQ ID NO: 1312 - DNA, 10 bp, Artificial Sequence
  Synthetic Polynucleotide
gaaggtcacg

SEQ ID NO: 1313 - DNA, 10 bp, Artificial Sequence
  Synthetic Polynucleotide
gctccttgtc

SEQ ID NO: 1314 - DNA, 10 bp, Artificial Sequence
  Synthetic Polynucleotide
ccgtctttga

SEQ ID NO: 1315 - DNA, 10 bp, Artificial Sequence
  Synthetic Polynucleotide
aggtcggaaa

SEQ ID NO: 1316 - DNA, 10 bp, Artificial Sequence
  Synthetic Polynucleotide
aactgctccg

SEQ ID NO: 1317 - DNA, 10 bp, Artificial Sequence
  Synthetic Polynucleotide
ggacggaact

SEQ ID NO: 1318 - DNA, 10 bp, Artificial Sequence
  Synthetic Polynucleotide
gtccccgtcg

SEQ ID NO: 1319 - DNA, 10 bp, Artificial Sequence
  Synthetic Polynucleotide
ggagacggtg

SEQ ID NO: 1320 - DNA, 10 bp, Artificial Sequence
  Synthetic Polynucleotide
tgttggtggt

SEQ ID NO: 1321 - DNA, 10 bp, Artificial Sequence
  Synthetic Polynucleotide
acgacaaggt

SEQ ID NO: 1322 - DNA, 10 bp, Artificial Sequence
  Synthetic Polynucleotide
gagttgcaga

SEQ ID NO: 1323 - DNA, 10 bp, Artificial Sequence
  Synthetic Polynucleotide
tttccgcttg

SEQ ID NO: 1324 - DNA, 10 bp, Artificial Sequence
  Synthetic Polynucleotide
tcaacgcttc

SEQ ID NO: 1325 - DNA, 10 bp, Artificial Sequence
  Synthetic Polynucleotide
tcggctaaag

SEQ ID NO: 1326 - DNA, 10 bp, Artificial Sequence
  Synthetic Polynucleotide
agcccgatct

SEQ ID NO: 1327 - DNA, 10 bp, Artificial Sequence
  Synthetic Polynucleotide
gatgcagcgc

SEQ ID NO: 1328 - DNA, 10 bp, Artificial Sequence
  Synthetic Polynucleotide
ccaacgtcag

SEQ ID NO: 1329 - DNA, 10 bp, Artificial Sequence
  Synthetic Polynucleotide
gggtggttct

SEQ ID NO: 1330 - DNA, 10 bp, Artificial Sequence
  Synthetic Polynucleotide
aagcagagcc

SEQ ID NO: 1331 - DNA, 10 bp, Artificial Sequence
  Synthetic Polynucleotide
ctcgtcggat

SEQ ID NO: 1332 - DNA, 10 bp, Artificial Sequence
  Synthetic Polynucleotide
caacgcatcg

SEQ ID NO: 1333 - DNA, 10 bp, Artificial Sequence
  Synthetic Polynucleotide
atggtcaccg

SEQ ID NO: 1334 - DNA, 10 bp, Artificial Sequence
  Synthetic Polynucleotide
tgcagactgg

SEQ ID NO: 1335 - DNA, 10 bp, Artificial Sequence
  Synthetic Polynucleotide
tactgcgtta

SEQ ID NO: 1336 - DNA, 10 bp, Artificial Sequence
  Synthetic Polynucleotide
gcccctctca

SEQ ID NO: 1337 - DNA, 10 bp, Artificial Sequence
  Synthetic Polynucleotide
tcagcttcgg

SEQ ID NO: 1338 - DNA, 10 bp, Artificial Sequence
  Synthetic Polynucleotide
acctcgactt

SEQ ID NO: 1339 - DNA, 10 bp, Artificial Sequence
  Synthetic Polynucleotide
gctaccgcct

SEQ ID NO: 1340 - DNA, 10 bp, Artificial Sequence
  Synthetic Polynucleotide
ggggcagtgt

SEQ ID NO: 1341 - DNA, 10 bp, Artificial Sequence
  Synthetic Polynucleotide
taagctcggg

SEQ ID NO: 1342 - DNA, 10 bp, Artificial Sequence
  Synthetic Polynucleotide
atggtaggcc

SEQ ID NO: 1343 - DNA, 10 bp, Artificial Sequence
  Synthetic Polynucleotide
gacgacgaag

SEQ ID NO: 1344 - DNA, 10 bp, Artificial Sequence
  Synthetic Polynucleotide
ccaaaaccgg

SEQ ID NO: 1345 - DNA, 10 bp, Artificial Sequence
  Synthetic Polynucleotide
tcgggtggcc

SEQ ID NO: 1346 - DNA, 10 bp, Artificial Sequence
  Synthetic Polynucleotide
agcaaacgcc

SEQ ID NO: 1347 - DNA, 10 bp, Artificial Sequence
  Synthetic Polynucleotide
agctgcaaag

SEQ ID NO: 1348 - DNA, 10 bp, Artificial Sequence
  Synthetic Polynucleotide
ccattctgca

SEQ ID NO: 1349 - DNA, 10 bp, Artificial Sequence
  Synthetic Polynucleotide
actgaacgcc

SEQ ID NO: 1350 - DNA, 10 bp, Artificial Sequence
  Synthetic Polynucleotide
acaggttgcg

SEQ ID NO: 1351 - DNA, 10 bp, Artificial Sequence
  Synthetic Polynucleotide
tttgtgtgcc

SEQ ID NO: 1352 - DNA, 10 bp, Artificial Sequence
  Synthetic Polynucleotide
gaaccgccta

SEQ ID NO: 1353 - DNA, 10 bp, Artificial Sequence
  Synthetic Polynucleotide
ttcatcccgt

SEQ ID NO: 1354 - DNA, 10 bp, Artificial Sequence
  Synthetic Polynucleotide
accttgctga

SEQ ID NO: 1355 - DNA, 10 bp, Artificial Sequence
  Synthetic Polynucleotide
tcctcaagga

SEQ ID NO: 1356 - DNA, 10 bp, Artificial Sequence
  Synthetic Polynucleotide
attccgccga

SEQ ID NO: 1357 - DNA, 10 bp, Artificial Sequence
  Synthetic Polynucleotide
ccgctctaac

SEQ ID NO: 1358 - DNA, 10 bp, Artificial Sequence
  Synthetic Polynucleotide
catctgccgt

SEQ ID NO: 1359 - DNA, 10 bp, Artificial Sequence
  Synthetic Polynucleotide
gcgtgctatt

SEQ ID NO: 1360 - DNA, 10 bp, Artificial Sequence
  Synthetic Polynucleotide
tcacggttga

SEQ ID NO: 1361 - DNA, 10 bp, Artificial Sequence
  Synthetic Polynucleotide
ggtgttcagc

SEQ ID NO: 1362 - DNA, 10 bp, Artificial Sequence
  Synthetic Polynucleotide
tcactggcgt

SEQ ID NO: 1363 - DNA, 10 bp, Artificial Sequence
  Synthetic Polynucleotide
acgagctggc

SEQ ID NO: 1364 - DNA, 10 bp, Artificial Sequence
  Synthetic Polynucleotide
gatgatggcg

SEQ ID NO: 1365 - DNA, 10 bp, Artificial Sequence
  Synthetic Polynucleotide
caatgccgcc

SEQ ID NO: 1366 - DNA, 10 bp, Artificial Sequence
  Synthetic Polynucleotide
gcatgacggt

SEQ ID NO: 1367 - DNA, 10 bp, Artificial Sequence
  Synthetic Polynucleotide
gctgctgccg

SEQ ID NO: 1368 - DNA, 10 bp, Artificial Sequence
  Synthetic Polynucleotide
agctcttgct

SEQ ID NO: 1369 - DNA, 10 bp, Artificial Sequence
  Synthetic Polynucleotide
acgaagacga

SEQ ID NO: 1370 - DNA, 10 bp, Artificial Sequence
  Synthetic Polynucleotide
tccaccacca

SEQ ID NO: 1371 - DNA, 10 bp, Artificial Sequence
  Synthetic Polynucleotide
ggtggtggtg

SEQ ID NO: 1372 - DNA, 10 bp, Artificial Sequence
  Synthetic Polynucleotide
tggggttgca

SEQ ID NO: 1373 - DNA, 10 bp, Artificial Sequence
  Synthetic Polynucleotide
tgccgttctt

SEQ ID NO: 1374 - DNA, 10 bp, Artificial Sequence
  Synthetic Polynucleotide
cagcgttgat

SEQ ID NO: 1375 - DNA, 10 bp, Artificial Sequence
  Synthetic Polynucleotide
gcacctgcca

SEQ ID NO: 1376 - DNA, 10 bp, Artificial Sequence
  Synthetic Polynucleotide
gagtgccgcc

SEQ ID NO: 1377 - DNA, 10 bp, Artificial Sequence
  Synthetic Polynucleotide
catcgacgac

SEQ ID NO: 1378 - DNA, 10 bp, Artificial Sequence
  Synthetic Polynucleotide
tcgttgttga

SEQ ID NO: 1379 - DNA, 10 bp, Artificial Sequence
  Synthetic Polynucleotide
ccgatatgcc

SEQ ID NO: 1380 - DNA, 10 bp, Artificial Sequence
  Synthetic Polynucleotide
cagcagcagc

SEQ ID NO: 1381 - DNA, 10 bp, Artificial Sequence
  Synthetic Polynucleotide
aatgctgctg

SEQ ID NO: 1382 - DNA, 10 bp, Artificial Sequence
  Synthetic Polynucleotide
acatcggcac

SEQ ID NO: 1383 - DNA, 10 bp, Artificial Sequence
  Synthetic Polynucleotide
gttgacgacg

SEQ ID NO: 1384 - DNA, 10 bp, Artificial Sequence
  Synthetic Polynucleotide
atgggtcagc

SEQ ID NO: 1385 - DNA, 10 bp, Artificial Sequence
  Synthetic Polynucleotide
ggggatggtt

SEQ ID NO: 1386 - DNA, 10 bp, Artificial Sequence
  Synthetic Polynucleotide
gcattctgga

SEQ ID NO: 1387 - DNA, 10 bp, Artificial Sequence
  Synthetic Polynucleotide
cggtaaaggg

SEQ ID NO: 1388 - DNA, 10 bp, Artificial Sequence
  Synthetic Polynucleotide
gcgaatcagt

SEQ ID NO: 1389 - DNA, 10 bp, Artificial Sequence
  Synthetic Polynucleotide
agcaagagca

SEQ ID NO: 1390 - DNA, 10 bp, Artificial Sequence
  Synthetic Polynucleotide
tagcgttagg

SEQ ID NO: 1391 - DNA, 10 bp, Artificial Sequence
  Synthetic Polynucleotide
atggcaggag

SEQ ID NO: 1392 - DNA, 10 bp, Artificial Sequence
  Synthetic Polynucleotide
ttccgtctgg

SEQ ID NO: 1393 - DNA, 10 bp, Artificial Sequence
  Synthetic Polynucleotide
caacggaacc

SEQ ID NO: 1394 - DNA, 10 bp, Artificial Sequence
  Synthetic Polynucleotide
tgaaccgact

SEQ ID NO: 1395 - DNA, 10 bp, Artificial Sequence
  Synthetic Polynucleotide
atgagtggga

SEQ ID NO: 1396 - DNA, 10 bp, Artificial Sequence
  Synthetic Polynucleotide
tcttccgtca

SEQ ID NO: 1397 - DNA, 10 bp, Artificial Sequence
  Synthetic Polynucleotide
ggggcttagt

SEQ ID NO: 1398 - DNA, 10 bp, Artificial Sequence
  Synthetic Polynucleotide
gctcttccgt

SEQ ID NO: 1399 - DNA, 10 bp, Artificial Sequence
  Synthetic Polynucleotide
gcccttggat

SEQ ID NO: 1400 - DNA, 10 bp, Artificial Sequence
  Synthetic Polynucleotide
gtcggctgtc

SEQ ID NO: 1401 - DNA, 10 bp, Artificial Sequence
  Synthetic Polynucleotide
gcccacaagg

SEQ ID NO: 1402 - DNA, 10 bp, Artificial Sequence
  Synthetic Polynucleotide
tctgtcctca

SEQ ID NO: 1403 - DNA, 10 bp, Artificial Sequence
  Synthetic Polynucleotide
tcttcggaga

SEQ ID NO: 1404 - DNA, 10 bp, Artificial Sequence
  Synthetic Polynucleotide
ggccatacac

SEQ ID NO: 1405 - DNA, 10 bp, Artificial Sequence
  Synthetic Polynucleotide
tggcaacatg

SEQ ID NO: 1406 - DNA, 10 bp, Artificial Sequence
  Synthetic Polynucleotide
aactcgggac

SEQ ID NO: 1407 - DNA, 10 bp, Artificial Sequence
  Synthetic Polynucleotide
cacgctatga

SEQ ID NO: 1408 - DNA, 10 bp, Artificial Sequence
  Synthetic Polynucleotide
gcacatggaa

SEQ ID NO: 1409 - DNA, 10 bp, Artificial Sequence
  Synthetic Polynucleotide
tcgtggtccc

SEQ ID NO: 1410 - DNA, 10 bp, Artificial Sequence
  Synthetic Polynucleotide
agagtcacgt

SEQ ID NO: 1411 - DNA, 10 bp, Artificial Sequence
  Synthetic Polynucleotide
taaccccaac

SEQ ID NO: 1412 - DNA, 10 bp, Artificial Sequence
  Synthetic Polynucleotide
ggatcgcata

SEQ ID NO: 1413 - DNA, 10 bp, Artificial Sequence
  Synthetic Polynucleotide
tggcatcgac

SEQ ID NO: 1414 - DNA, 10 bp, Artificial Sequence
  Synthetic Polynucleotide
tccttggagg

SEQ ID NO: 1415 - DNA, 10 bp, Artificial Sequence
  Synthetic Polynucleotide
ccgtgctaag

SEQ ID NO: 1416 - DNA, 10 bp, Artificial Sequence
  Synthetic Polynucleotide
catcgggaca

SEQ ID NO: 1417 - DNA, 10 bp, Artificial Sequence
  Synthetic Polynucleotide
caagacgcta

SEQ ID NO: 1418 - DNA, 10 bp, Artificial Sequence
  Synthetic Polynucleotide
tgttttgggc

SEQ ID NO: 1419 - DNA, 10 bp, Artificial Sequence
  Synthetic Polynucleotide
cgcacaccgt

SEQ ID NO: 1420 - DNA, 10 bp, Artificial Sequence
  Synthetic Polynucleotide
atttgggccg

SEQ ID NO: 1421 - DNA, 10 bp, Artificial Sequence
  Synthetic Polynucleotide
cgaatctcgg

SEQ ID NO: 1422 - DNA, 10 bp, Artificial Sequence
  Synthetic Polynucleotide
catttgggcc

SEQ ID NO: 1423 - DNA, 10 bp, Artificial Sequence
  Synthetic Polynucleotide
cgtcatgtgc

SEQ ID NO: 1424 - DNA, 10 bp, Artificial Sequence
  Synthetic Polynucleotide
tatcgtcacc

SEQ ID NO: 1425 - DNA, 10 bp, Artificial Sequence
  Synthetic Polynucleotide
gctgcaactg

SEQ ID NO: 1426 - DNA, 10 bp, Artificial Sequence
  Synthetic Polynucleotide
acgacgctca

SEQ ID NO: 1427 - DNA, 10 bp, Artificial Sequence
  Synthetic Polynucleotide
tccagttcct

SEQ ID NO: 1428 - DNA, 10 bp, Artificial Sequence
  Synthetic Polynucleotide
actcaacgca

SEQ ID NO: 1429 - DNA, 10 bp, Artificial Sequence
  Synthetic Polynucleotide
gcgaccaaat

SEQ ID NO: 1430 - DNA, 10 bp, Artificial Sequence
  Synthetic Polynucleotide
tagcctttcc

SEQ ID NO: 1431 - DNA, 10 bp, Artificial Sequence
  Synthetic Polynucleotide
gccatccggt

SEQ ID NO: 1432 - DNA, 10 bp, Artificial Sequence
  Synthetic Polynucleotide
tcaggtcagg

SEQ ID NO: 1433 - DNA, 10 bp, Artificial Sequence
  Synthetic Polynucleotide
accaatggga

SEQ ID NO: 1434 - DNA, 10 bp, Artificial Sequence
  Synthetic Polynucleotide
tgaccacagt

SEQ ID NO: 1435 - DNA, 10 bp, Artificial Sequence
  Synthetic Polynucleotide
tctgcaactg

SEQ ID NO: 1436 - DNA, 10 bp, Artificial Sequence
  Synthetic Polynucleotide
cgctgcactc

SEQ ID NO: 1437 - DNA, 10 bp, Artificial Sequence
  Synthetic Polynucleotide
actccggcag

SEQ ID NO: 1438 - DNA, 10 bp, Artificial Sequence
  Synthetic Polynucleotide
cgctgctcct

SEQ ID NO: 1439 - DNA, 10 bp, Artificial Sequence
  Synthetic Polynucleotide
ttcctgcctg

SEQ ID NO: 1440 - DNA, 10 bp, Artificial Sequence
  Synthetic Polynucleotide
cgaaaaccgc

SEQ ID NO: 1441 - DNA, 10 bp, Artificial Sequence
  Synthetic Polynucleotide
gtgacgcaga

SEQ ID NO: 1442 - DNA, 10 bp, Artificial Sequence
  Synthetic Polynucleotide
gctttgacca

SEQ ID NO: 1443 - DNA, 10 bp, Artificial Sequence
  Synthetic Polynucleotide
tggaccgttg

SEQ ID NO: 1444 - DNA, 10 bp, Artificial Sequence
  Synthetic Polynucleotide
gcgctaaggg

SEQ ID NO: 1445 - DNA, 10 bp, Artificial Sequence
  Synthetic Polynucleotide
tgtgggagag

SEQ ID NO: 1446 - DNA, 10 bp, Artificial Sequence
  Synthetic Polynucleotide
cgcctgacaa

SEQ ID NO: 1447 - DNA, 10 bp, Artificial Sequence
  Synthetic Polynucleotide
accccaacgt

SEQ ID NO: 1448 - DNA, 10 bp, Artificial Sequence
  Synthetic Polynucleotide
ccgtcggagt

SEQ ID NO: 1449 - DNA, 10 bp, Artificial Sequence
  Synthetic Polynucleotide
gttcgctcgt

SEQ ID NO: 1450 - DNA, 10 bp, Artificial Sequence
  Synthetic Polynucleotide
gctgctccag

SEQ ID NO: 1451 - DNA, 10 bp, Artificial Sequence
  Synthetic Polynucleotide
attggcaacg

SEQ ID NO: 1452 - DNA, 10 bp, Artificial Sequence
  Synthetic Polynucleotide
tcaacgcttc

SEQ ID NO: 1453 - DNA, 10 bp, Artificial Sequence
  Synthetic Polynucleotide
tacctggccc

SEQ ID NO: 1454 - DNA, 10 bp, Artificial Sequence
  Synthetic Polynucleotide
tggagacgat

SEQ ID NO: 1455 - DNA, 10 bp, Artificial Sequence
  Synthetic Polynucleotide
aaggacgtgc

SEQ ID NO: 1456 - DNA, 10 bp, Artificial Sequence
  Synthetic Polynucleotide
cctgcaacag

SEQ ID NO: 1457 - DNA, 10 bp, Artificial Sequence
  Synthetic Polynucleotide
cgcgatggcc

SEQ ID NO: 1458 - DNA, 10 bp, Artificial Sequence
  Synthetic Polynucleotide
tgcttgttcc

SEQ ID NO: 1459 - DNA, 10 bp, Artificial Sequence
  Synthetic Polynucleotide
ggatgatggc

SEQ ID NO: 1460 - DNA, 10 bp, Artificial Sequence
  Synthetic Polynucleotide
cctgagcaca

SEQ ID NO: 1461 - DNA, 10 bp, Artificial Sequence
  Synthetic Polynucleotide
tagcatggtc

SEQ ID NO: 1462 - DNA, 10 bp, Artificial Sequence
  Synthetic Polynucleotide
tggcaaagga

SEQ ID NO: 1463 - DNA, 10 bp, Artificial Sequence
  Synthetic Polynucleotide
tggcaacagg

SEQ ID NO: 1464 - DNA, 10 bp, Artificial Sequence
  Synthetic Polynucleotide
gccaagacca

SEQ ID NO: 1465 - DNA, 10 bp, Artificial Sequence
  Synthetic Polynucleotide
tctgggttga

SEQ ID NO: 1466 - DNA, 10 bp, Artificial Sequence
  Synthetic Polynucleotide
ggagcacatc

SEQ ID NO: 1467 - DNA, 10 bp, Artificial Sequence
  Synthetic Polynucleotide
ggaggatggc

SEQ ID NO: 1468 - DNA, 10 bp, Artificial Sequence
  Synthetic Polynucleotide
cccagggaga

SEQ ID NO: 1469 - DNA, 10 bp, Artificial Sequence
  Synthetic Polynucleotide
ggagccattg

SEQ ID NO: 1470 - DNA, 10 bp, Artificial Sequence
  Synthetic Polynucleotide
gccatcatcc

SEQ ID NO: 1471 - DNA, 10 bp, Artificial Sequence
  Synthetic Polynucleotide
cgcgagatac

SEQ ID NO: 1472 - DNA, 10 bp, Artificial Sequence
  Synthetic Polynucleotide
gctgctcgaa

SEQ ID NO: 1473 - DNA, 10 bp, Artificial Sequence
  Synthetic Polynucleotide
acagtggagg

SEQ ID NO: 1474 - DNA, 10 bp, Artificial Sequence
  Synthetic Polynucleotide
gctgaaacga

SEQ ID NO: 1475 - DNA, 10 bp, Artificial Sequence
  Synthetic Polynucleotide
tccaggacat

SEQ ID NO: 1476 - DNA, 10 bp, Artificial Sequence
  Synthetic Polynucleotide
tgcttctcca

SEQ ID NO: 1477 - DNA, 10 bp, Artificial Sequence
  Synthetic Polynucleotide
tgtggaccaa

SEQ ID NO: 1478 - DNA, 10 bp, Artificial Sequence
  Synthetic Polynucleotide
cccaagccat

SEQ ID NO: 1479 - DNA, 10 bp, Artificial Sequence
  Synthetic Polynucleotide
gtgactggtg

SEQ ID NO: 1480 - DNA, 10 bp, Artificial Sequence
  Synthetic Polynucleotide
tgctgtgttc

SEQ ID NO: 1481 - DNA, 10 bp, Artificial Sequence
  Synthetic Polynucleotide
gcagaaggcc

SEQ ID NO: 1482 - DNA, 10 bp, Artificial Sequence
  Synthetic Polynucleotide
ctgctgtgtc

SEQ ID NO: 1483 - DNA, 10 bp, Artificial Sequence
  Synthetic Polynucleotide
gctgcctatg

SEQ ID NO: 1484 - DNA, 10 bp, Artificial Sequence
  Synthetic Polynucleotide
caccgcatgt

SEQ ID NO: 1485 - DNA, 10 bp, Artificial Sequence
  Synthetic Polynucleotide
gcttcggggc

SEQ ID NO: 1486 - DNA, 10 bp, Artificial Sequence
  Synthetic Polynucleotide
ggccctatca

SEQ ID NO: 1487 - DNA, 10 bp, Artificial Sequence
  Synthetic Polynucleotide
acgcccaata

SEQ ID NO: 1488 - DNA, 10 bp, Artificial Sequence
  Synthetic Polynucleotide
cctgaccagt

SEQ ID NO: 1489 - DNA, 10 bp, Artificial Sequence
  Synthetic Polynucleotide
tgacggatgg

SEQ ID NO: 1490 - DNA, 10 bp, Artificial Sequence
  Synthetic Polynucleotide
tgccagttgt

SEQ ID NO: 1491 - DNA, 10 bp, Artificial Sequence
  Synthetic Polynucleotide
gcacaagctg

SEQ ID NO: 1492 - DNA, 10 bp, Artificial Sequence
  Synthetic Polynucleotide
cttctgccag

SEQ ID NO: 1493 - DNA, 10 bp, Artificial Sequence
  Synthetic Polynucleotide
tcttcagtgc

SEQ ID NO: 1494 - DNA, 10 bp, Artificial Sequence
  Synthetic Polynucleotide
gttgagctgc

SEQ ID NO: 1495 - DNA, 10 bp, Artificial Sequence
  Synthetic Polynucleotide
tcagctccct

SEQ ID NO: 1496 - DNA, 10 bp, Artificial Sequence
  Synthetic Polynucleotide
gctttgacca

SEQ ID NO: 1497 - DNA, 10 bp, Artificial Sequence
  Synthetic Polynucleotide
acggcatcaa

SEQ ID NO: 1498 - DNA, 10 bp, Artificial Sequence
  Synthetic Polynucleotide
acaagggtgt

SEQ ID NO: 1499 - DNA, 10 bp, Artificial Sequence
  Synthetic Polynucleotide
tgaacaggga

SEQ ID NO: 1500 - DNA, 10 bp, Artificial Sequence
  Synthetic Polynucleotide
gacgttgcct

SEQ ID NO: 1501 - DNA, 10 bp, Artificial Sequence
  Synthetic Polynucleotide
tggaagcact

SEQ ID NO: 1502 - DNA, 10 bp, Artificial Sequence
  Synthetic Polynucleotide
tacgagccat

SEQ ID NO: 1503 - DNA, 10 bp, Artificial Sequence
  Synthetic Polynucleotide
gctaccatgc

SEQ ID NO: 1504 - DNA, 10 bp, Artificial Sequence
  Synthetic Polynucleotide
tggtgtcact

SEQ ID NO: 1505 - DNA, 10 bp, Artificial Sequence
  Synthetic Polynucleotide
gggtgaacca

SEQ ID NO: 1506 - DNA, 10 bp, Artificial Sequence
  Synthetic Polynucleotide
tccatcgtgc

SEQ ID NO: 1507 - DNA, 10 bp, Artificial Sequence
  Synthetic Polynucleotide
gccaaagagg

SEQ ID NO: 1508 - DNA, 10 bp, Artificial Sequence
  Synthetic Polynucleotide
aaggctttgc

SEQ ID NO: 1509 - DNA, 10 bp, Artificial Sequence
  Synthetic Polynucleotide
gatggagggc

SEQ ID NO: 1510 - DNA, 10 bp, Artificial Sequence
  Synthetic Polynucleotide
cccctggtct

SEQ ID NO: 1511 - DNA, 10 bp, Artificial Sequence
  Synthetic Polynucleotide
cagcaatgga

SEQ ID NO: 1512 - DNA, 10 bp, Artificial Sequence
  Synthetic Polynucleotide
tagattgggc

SEQ ID NO: 1513 - DNA, 10 bp, Artificial Sequence
  Synthetic Polynucleotide
caacagcaca

SEQ ID NO: 1514 - DNA, 10 bp, Artificial Sequence
  Synthetic Polynucleotide
gcttcagcga

SEQ ID NO: 1515 - DNA, 10 bp, Artificial Sequence
  Synthetic Polynucleotide
tggatcggga

SEQ ID NO: 1516 - DNA, 10 bp, Artificial Sequence
  Synthetic Polynucleotide
aagggtcggc

SEQ ID NO: 1517 - DNA, 10 bp, Artificial Sequence
  Synthetic Polynucleotide
tcggttccca

SEQ ID NO: 1518 - DNA, 10 bp, Artificial Sequence
  Synthetic Polynucleotide
agttccccta

SEQ ID NO: 1519 - DNA, 10 bp, Artificial Sequence
  Synthetic Polynucleotide
ccgtggtaga

SEQ ID NO: 1520 - DNA, 10 bp, Artificial Sequence
  Synthetic Polynucleotide
caggatgccg

SEQ ID NO: 1521 - DNA, 10 bp, Artificial Sequence
  Synthetic Polynucleotide
cgacgatgac

SEQ ID NO: 1522 - DNA, 10 bp, Artificial Sequence
  Synthetic Polynucleotide
ccgtgtttga

SEQ ID NO: 1523 - DNA, 10 bp, Artificial Sequence
  Synthetic Polynucleotide
tgttgttgcc

SEQ ID NO: 1524 - DNA, 10 bp, Artificial Sequence
  Synthetic Polynucleotide
tccccattga

SEQ ID NO: 1525 - DNA, 10 bp, Artificial Sequence
  Synthetic Polynucleotide
tgggatgcat

SEQ ID NO: 1526 - DNA, 10 bp, Artificial Sequence
  Synthetic Polynucleotide
gcataggcac

SEQ ID NO: 1527 - DNA, 10 bp, Artificial Sequence
  Synthetic Polynucleotide
tacaggcagc

SEQ ID NO: 1528 - DNA, 10 bp, Artificial Sequence
  Synthetic Polynucleotide
ccatccatgc

SEQ ID NO: 1529 - DNA, 10 bp, Artificial Sequence
  Synthetic Polynucleotide
acaaaaggcc

SEQ ID NO: 1530 - DNA, 10 bp, Artificial Sequence
  Synthetic Polynucleotide
ctgctcgata

SEQ ID NO: 1531 - DNA, 10 bp, Artificial Sequence
  Synthetic Polynucleotide
tatgcagcag

SEQ ID NO: 1532 - DNA, 10 bp, Artificial Sequence
  Synthetic Polynucleotide
ccaatgctca

SEQ ID NO: 1533 - DNA, 10 bp, Artificial Sequence
  Synthetic Polynucleotide
gatgggcatg

SEQ ID NO: 1534 - DNA, 10 bp, Artificial Sequence
  Synthetic Polynucleotide
ccatcaggcc

SEQ ID NO: 1535 - DNA, 10 bp, Artificial Sequence
  Synthetic Polynucleotide
gtgctcagca

SEQ ID NO: 1536 - DNA, 10 bp, Artificial Sequence
  Synthetic Polynucleotide
cctctccaga

SEQ ID NO: 1537 - DNA, 10 bp, Artificial Sequence
  Synthetic Polynucleotide
gcaccaaacg

SEQ ID NO: 1538 - DNA, 10 bp, Artificial Sequence
  Synthetic Polynucleotide
tgattgccag

SEQ ID NO: 1539 - DNA, 10 bp, Artificial Sequence
  Synthetic Polynucleotide
tcaaaaggca

SEQ ID NO: 1540 - DNA, 10 bp, Artificial Sequence
  Synthetic Polynucleotide
actccacaca

SEQ ID NO: 1541 - DNA, 10 bp, Artificial Sequence
  Synthetic Polynucleotide
accccaatga

SEQ ID NO: 1542 - DNA, 10 bp, Artificial Sequence
  Synthetic Polynucleotide
ccatcatggc

SEQ ID NO: 1543 - DNA, 10 bp, Artificial Sequence
  Synthetic Polynucleotide
agcaaaagca

SEQ ID NO: 1544 - DNA, 10 bp, Artificial Sequence
  Synthetic Polynucleotide
gcccacaaaa

SEQ ID NO: 1545 - DNA, 10 bp, Artificial Sequence
  Synthetic Polynucleotide
gctggcaagg

SEQ ID NO: 1546 - DNA, 10 bp, Artificial Sequence
  Synthetic Polynucleotide
cgagagcata

SEQ ID NO: 1547 - DNA, 10 bp, Artificial Sequence
  Synthetic Polynucleotide
gcggattcgt

SEQ ID NO: 1548 - DNA, 10 bp, Artificial Sequence
  Synthetic Polynucleotide
gcttgagtgc

SEQ ID NO: 1549 - DNA, 10 bp, Artificial Sequence
  Synthetic Polynucleotide
tcagatgcac

SEQ ID NO: 1550 - DNA, 10 bp, Artificial Sequence
  Synthetic Polynucleotide
ttgtccctgc

SEQ ID NO: 1551 - DNA, 10 bp, Artificial Sequence
  Synthetic Polynucleotide
gccatgacgg

SEQ ID NO: 1552 - DNA, 10 bp, Artificial Sequence
  Synthetic Polynucleotide
atgtcctggc

SEQ ID NO: 1553 - DNA, 10 bp, Artificial Sequence
  Synthetic Polynucleotide
tgtgtgatgc

SEQ ID NO: 1554 - DNA, 10 bp, Artificial Sequence
  Synthetic Polynucleotide
gagcaaagga

SEQ ID NO: 1555 - DNA, 10 bp, Artificial Sequence
  Synthetic Polynucleotide
tagcccttct

SEQ ID NO: 1556 - DNA, 10 bp, Artificial Sequence
  Synthetic Polynucleotide
gccccgaagc

SEQ ID NO: 1557 - DNA, 10 bp, Artificial Sequence
  Synthetic Polynucleotide
atggatggga

SEQ ID NO: 1558 - DNA, 10 bp, Artificial Sequence
  Synthetic Polynucleotide
tcgccaaaat

SEQ ID NO: 1559 - DNA, 10 bp, Artificial Sequence
  Synthetic Polynucleotide
tggcaacagg

SEQ ID NO: 1560 - DNA, 10 bp, Artificial Sequence
  Synthetic Polynucleotide
tgccctcaat

SEQ ID NO: 1561 - DNA, 10 bp, Artificial Sequence
  Synthetic Polynucleotide
gccgaccaaa

SEQ ID NO: 1562 - DNA, 10 bp, Artificial Sequence
  Synthetic Polynucleotide
gcaatgcagc

SEQ ID NO: 1563 - DNA, 10 bp, Artificial Sequence
  Synthetic Polynucleotide
tgtttggtgc

SEQ ID NO: 1564 - DNA, 10 bp, Artificial Sequence
  Synthetic Polynucleotide
ttgccagtgc

SEQ ID NO: 1565 - DNA, 10 bp, Artificial Sequence
  Synthetic Polynucleotide
tggcaaggaa

SEQ ID NO: 1566 - DNA, 10 bp, Artificial Sequence
  Synthetic Polynucleotide
cctggagtgc

SEQ ID NO: 1567 - DNA, 10 bp, Artificial Sequence
  Synthetic Polynucleotide
tgcatgagct

SEQ ID NO: 1568 - DNA, 10 bp, Artificial Sequence
  Synthetic Polynucleotide
gcaagatccc

SEQ ID NO: 1569 - DNA, 10 bp, Artificial Sequence
  Synthetic Polynucleotide
atggtgcagg

SEQ ID NO: 1570 - DNA, 10 bp, Artificial Sequence
  Synthetic Polynucleotide
agcatgagca

SEQ ID NO: 1571 - DNA, 10 bp, Artificial Sequence
  Synthetic Polynucleotide
tcagccaagg

SEQ ID NO: 1572 - DNA, 10 bp, Artificial Sequence
  Synthetic Polynucleotide
tgccatcatg

SEQ ID NO: 1573 - DNA, 10 bp, Artificial Sequence
  Synthetic Polynucleotide
ggaatgcaga

SEQ ID NO: 1574 - DNA, 10 bp, Artificial Sequence
  Synthetic Polynucleotide
tgattgggcc

SEQ ID NO: 1575 - DNA, 10 bp, Artificial Sequence
  Synthetic Polynucleotide
tgcagacaca

SEQ ID NO: 1576 - DNA, 10 bp, Artificial Sequence
  Synthetic Polynucleotide
gcagcaaacc

SEQ ID NO: 1577 - DNA, 10 bp, Artificial Sequence
  Synthetic Polynucleotide
tagaaggggt

SEQ ID NO: 1578 - DNA, 10 bp, Artificial Sequence
  Synthetic Polynucleotide
cctgggtagc

SEQ ID NO: 1579 - DNA, 10 bp, Artificial Sequence
  Synthetic Polynucleotide
agcaaaagca

SEQ ID NO: 1580 - DNA, 10 bp, Artificial Sequence
  Synthetic Polynucleotide
gccatccaca

SEQ ID NO: 1581 - DNA, 10 bp, Artificial Sequence
  Synthetic Polynucleotide
ttctggaggg

SEQ ID NO: 1582 - DNA, 10 bp, Artificial Sequence
  Synthetic Polynucleotide
tctggggtga

SEQ ID NO: 1583 - DNA, 10 bp, Artificial Sequence
  Synthetic Polynucleotide
tcatggtcct

SEQ ID NO: 1584 - DNA, 10 bp, Artificial Sequence
  Synthetic Polynucleotide
gtgcatctga

SEQ ID NO: 1585 - DNA, 10 bp, Artificial Sequence
  Synthetic Polynucleotide
tgggaccttt

SEQ ID NO: 1586 - DNA, 10 bp, Artificial Sequence
  Synthetic Polynucleotide
gctccaaaga

SEQ ID NO: 1587 - DNA, 10 bp, Artificial Sequence
  Synthetic Polynucleotide
aatgccccaa

SEQ ID NO: 1588 - DNA, 10 bp, Artificial Sequence
  Synthetic Polynucleotide
catcgtggca

SEQ ID NO: 1589 - DNA, 10 bp, Artificial Sequence
  Synthetic Polynucleotide
agcaaaagca

SEQ ID NO: 1590 - DNA, 10 bp, Artificial Sequence
  Synthetic Polynucleotide
ccatggtgta

SEQ ID NO: 1591 - DNA, 10 bp, Artificial Sequence
  Synthetic Polynucleotide
aagtgccagc

SEQ ID NO: 1592 - DNA, 10 bp, Artificial Sequence
  Synthetic Polynucleotide
tagggttcct

SEQ ID NO: 1593 - DNA, 10 bp, Artificial Sequence
  Synthetic Polynucleotide
tggcaaatgg

SEQ ID NO: 1594 - DNA, 10 bp, Artificial Sequence
  Synthetic Polynucleotide
gactgctcga

SEQ ID NO: 1595 - DNA, 10 bp, Artificial Sequence
  Synthetic Polynucleotide
ggaggatgga

SEQ ID NO: 1596 - DNA, 10 bp, Artificial Sequence
  Synthetic Polynucleotide
gtggaatggc

SEQ ID NO: 1597 - DNA, 10 bp, Artificial Sequence
  Synthetic Polynucleotide
ggcaaagtgg

SEQ ID NO: 1598 - DNA, 10 bp, Artificial Sequence
  Synthetic Polynucleotide
tgcattgtcc

SEQ ID NO: 1599 - DNA, 10 bp, Artificial Sequence
  Synthetic Polynucleotide
gcagtgacac

SEQ ID NO: 1600 - DNA, 10 bp, Artificial Sequence
  Synthetic Polynucleotide
aacctgtggt

SEQ ID NO: 1601 - DNA, 10 bp, Artificial Sequence
  Synthetic Polynucleotide
gcaacagggt

SEQ ID NO: 1602 - DNA, 10 bp, Artificial Sequence
  Synthetic Polynucleotide
tcctgaccaa

SEQ ID NO: 1603 - DNA, 10 bp, Artificial Sequence
  Synthetic Polynucleotide
tgccaacaga

SEQ ID NO: 1604 - DNA, 10 bp, Artificial Sequence
  Synthetic Polynucleotide
ccatcaggcc

SEQ ID NO: 1605 - DNA, 10 bp, Artificial Sequence
  Synthetic Polynucleotide
tgcagagaca

SEQ ID NO: 1606 - DNA, 10 bp, Artificial Sequence
  Synthetic Polynucleotide
accagcaatg

SEQ ID NO: 1607 - DNA, 10 bp, Artificial Sequence
  Synthetic Polynucleotide
tggggcattc

SEQ ID NO: 1608 - DNA, 10 bp, Artificial Sequence
  Synthetic Polynucleotide
tgctccactt

SEQ ID NO: 1609 - DNA, 10 bp, Artificial Sequence
  Synthetic Polynucleotide
tcctcatcgg

SEQ ID NO: 1610 - DNA, 10 bp, Artificial Sequence
  Synthetic Polynucleotide
gatccagcca

SEQ ID NO: 1611 - DNA, 10 bp, Artificial Sequence
  Synthetic Polynucleotide
cacgctcacc

SEQ ID NO: 1612 - DNA, 10 bp, Artificial Sequence
  Synthetic Polynucleotide
tgacaagccc

SEQ ID NO: 1613 - DNA, 10 bp, Artificial Sequence
  Synthetic Polynucleotide
aggaacagga

SEQ ID NO: 1614 - DNA, 10 bp, Artificial Sequence
  Synthetic Polynucleotide
caggcactcc

SEQ ID NO: 1615 - DNA, 10 bp, Artificial Sequence
  Synthetic Polynucleotide
gcatctccac

SEQ ID NO: 1616 - DNA, 10 bp, Artificial Sequence
  Synthetic Polynucleotide
cagccactgc

SEQ ID NO: 1617 - DNA, 10 bp, Artificial Sequence
  Synthetic Polynucleotide
cttggtcagc

SEQ ID NO: 1618 - DNA, 10 bp, Artificial Sequence
  Synthetic Polynucleotide
attcctcgct

SEQ ID NO: 1619 - DNA, 10 bp, Artificial Sequence
  Synthetic Polynucleotide
gatgcaagga

SEQ ID NO: 1620 - DNA, 10 bp, Artificial Sequence
  Synthetic Polynucleotide
tcaaagctgc

SEQ ID NO: 1621 - DNA, 10 bp, Artificial Sequence
  Synthetic Polynucleotide
agcaaaagca

SEQ ID NO: 1622 - DNA, 10 bp, Artificial Sequence
  Synthetic Polynucleotide
catcctcccc

SEQ ID NO: 1623 - DNA, 10 bp, Artificial Sequence
  Synthetic Polynucleotide
gggtcatgtg

SEQ ID NO: 1624 - DNA, 10 bp, Artificial Sequence
  Synthetic Polynucleotide
ggccatctgt

SEQ ID NO: 1625 - DNA, 10 bp, Artificial Sequence
  Synthetic Polynucleotide
gtcacaaggg

SEQ ID NO: 1626 - DNA, 10 bp, Artificial Sequence
  Synthetic Polynucleotide
ctgcttgcaa

SEQ ID NO: 1627 - DNA, 10 bp, Artificial Sequence
  Synthetic Polynucleotide
tgtttggagc

SEQ ID NO: 1628 - DNA, 10 bp, Artificial Sequence
  Synthetic Polynucleotide
caatcggcaa

SEQ ID NO: 1629 - DNA, 10 bp, Artificial Sequence
  Synthetic Polynucleotide
gtcgaacctc

SEQ ID NO: 1630 - DNA, 10 bp, Artificial Sequence
  Synthetic Polynucleotide
tggtggaaca

SEQ ID NO: 1631 - DNA, 10 bp, Artificial Sequence
  Synthetic Polynucleotide
ccatggtgtc

SEQ ID NO: 1632 - DNA, 10 bp, Artificial Sequence
  Synthetic Polynucleotide
gtcctgttgc

SEQ ID NO: 1633 - DNA, 10 bp, Artificial Sequence
  Synthetic Polynucleotide
cacgatcagc

SEQ ID NO: 1634 - DNA, 10 bp, Artificial Sequence
  Synthetic Polynucleotide
ccgtttccgt

SEQ ID NO: 1635 - DNA, 10 bp, Artificial Sequence
  Synthetic Polynucleotide
tgatgtggga

SEQ ID NO: 1636 - DNA, 10 bp, Artificial Sequence
  Synthetic Polynucleotide
cacaaggtcc

SEQ ID NO: 1637 - DNA, 10 bp, Artificial Sequence
  Synthetic Polynucleotide
gaatgctgga

SEQ ID NO: 1638 - DNA, 10 bp, Artificial Sequence
  Synthetic Polynucleotide
tcccattgga

SEQ ID NO: 1639 - DNA, 10 bp, Artificial Sequence
  Synthetic Polynucleotide
ctgtgtgcaa

SEQ ID NO: 1640 - DNA, 10 bp, Artificial Sequence
  Synthetic Polynucleotide
ggtgactgtg

SEQ ID NO: 1641 - DNA, 10 bp, Artificial Sequence
  Synthetic Polynucleotide
tgtaccgagt

SEQ ID NO: 1642 - DNA, 10 bp, Artificial Sequence
  Synthetic Polynucleotide
tcgaactgtg

SEQ ID NO: 1643 - DNA, 10 bp, Artificial Sequence
  Synthetic Polynucleotide
gatgccccat

SEQ ID NO: 1644 - DNA, 10 bp, Artificial Sequence
  Synthetic Polynucleotide
tccaccaact

SEQ ID NO: 1645 - DNA, 10 bp, Artificial Sequence
  Synthetic Polynucleotide
accaagtgga

SEQ ID NO: 1646 - DNA, 10 bp, Artificial Sequence
  Synthetic Polynucleotide
atcacgaccc

SEQ ID NO: 1647 - DNA, 10 bp, Artificial Sequence
  Synthetic Polynucleotide
ggcaatagca

SEQ ID NO: 1648 - DNA, 10 bp, Artificial Sequence
  Synthetic Polynucleotide
agtgccacaa

SEQ ID NO: 1649 - DNA, 10 bp, Artificial Sequence
  Synthetic Polynucleotide
caggaagtgc

SEQ ID NO: 1650 - DNA, 10 bp, Artificial Sequence
  Synthetic Polynucleotide
tcgccaaaat

SEQ ID NO: 1651 - DNA, 10 bp, Artificial Sequence
  Synthetic Polynucleotide
catggagagc

SEQ ID NO: 1652 - DNA, 10 bp, Artificial Sequence
  Synthetic Polynucleotide
tctgtgctgg

SEQ ID NO: 1653 - DNA, 10 bp, Artificial Sequence
  Synthetic Polynucleotide
agcacagctt

SEQ ID NO: 1654 - DNA, 10 bp, Artificial Sequence
  Synthetic Polynucleotide
actccccaga

SEQ ID NO: 1655 - DNA, 10 bp, Artificial Sequence
  Synthetic Polynucleotide
agcaggggaa

SEQ ID NO: 1656 - DNA, 10 bp, Artificial Sequence
  Synthetic Polynucleotide
gcaacactgc

SEQ ID NO: 1657 - DNA, 10 bp, Artificial Sequence
  Synthetic Polynucleotide
gggctctttg

SEQ ID NO: 1658 - DNA, 10 bp, Artificial Sequence
  Synthetic Polynucleotide
cccgaagcta

SEQ ID NO: 1659 - DNA, 10 bp, Artificial Sequence
  Synthetic Polynucleotide
acggatggga

SEQ ID NO: 1660 - DNA, 10 bp, Artificial Sequence
  Synthetic Polynucleotide
tcaaggcagt

SEQ ID NO: 1661 - DNA, 10 bp, Artificial Sequence
  Synthetic Polynucleotide
tgctcatcgg

SEQ ID NO: 1662 - DNA, 10 bp, Artificial Sequence
  Synthetic Polynucleotide
agccagacca

SEQ ID NO: 1663 - DNA, 10 bp, Artificial Sequence
  Synthetic Polynucleotide
tatccaggca

SEQ ID NO: 1664 - DNA, 10 bp, Artificial Sequence
  Synthetic Polynucleotide
tctccttccc

SEQ ID NO: 1665 - DNA, 10 bp, Artificial Sequence
  Synthetic Polynucleotide
actgctttgc

SEQ ID NO: 1666 - DNA, 10 bp, Artificial Sequence
  Synthetic Polynucleotide
tctcctccca

SEQ ID NO: 1667 - DNA, 10 bp, Artificial Sequence
  Synthetic Polynucleotide
gccaggcgat

SEQ ID NO: 1668 - DNA, 10 bp, Artificial Sequence
  Synthetic Polynucleotide
tccctgcata

SEQ ID NO: 1669 - DNA, 10 bp, Artificial Sequence
  Synthetic Polynucleotide
gcagttgctt

SEQ ID NO: 1670 - DNA, 10 bp, Artificial Sequence
  Synthetic Polynucleotide
ctctttccgg

SEQ ID NO: 1671 - DNA, 10 bp, Artificial Sequence
  Synthetic Polynucleotide
acagacaggc

SEQ ID NO: 1672 - DNA, 10 bp, Artificial Sequence
  Synthetic Polynucleotide
acttgacgca

SEQ ID NO: 1673 - DNA, 10 bp, Artificial Sequence
  Synthetic Polynucleotide
aaagtggtgc

SEQ ID NO: 1674 - DNA, 10 bp, Artificial Sequence
  Synthetic Polynucleotide
ccattctgca

SEQ ID NO: 1675 - DNA, 10 bp, Artificial Sequence
  Synthetic Polynucleotide
ccaatgggac

SEQ ID NO: 1676 - DNA, 10 bp, Artificial Sequence
  Synthetic Polynucleotide
ccactgcaaa

SEQ ID NO: 1677 - DNA, 10 bp, Artificial Sequence
  Synthetic Polynucleotide
gagcctttga

SEQ ID NO: 1678 - DNA, 10 bp, Artificial Sequence
  Synthetic Polynucleotide
ccaaccgaag

SEQ ID NO: 1679 - DNA, 10 bp, Artificial Sequence
  Synthetic Polynucleotide
aggagctgga

SEQ ID NO: 1680 - DNA, 10 bp, Artificial Sequence
  Synthetic Polynucleotide
ggcatgtggc

SEQ ID NO: 1681 - DNA, 10 bp, Artificial Sequence
  Synthetic Polynucleotide
gctggtcata

SEQ ID NO: 1682 - DNA, 10 bp, Artificial Sequence
  Synthetic Polynucleotide
atctgccgag

SEQ ID NO: 1683 - DNA, 10 bp, Artificial Sequence
  Synthetic Polynucleotide
actgatgcgg

SEQ ID NO: 1684 - DNA, 10 bp, Artificial Sequence
  Synthetic Polynucleotide
tgctcgttta

SEQ ID NO: 1685 - DNA, 10 bp, Artificial Sequence
  Synthetic Polynucleotide
gccagaatgg

SEQ ID NO: 1686 - DNA, 10 bp, Artificial Sequence
  Synthetic Polynucleotide
tctgagctgt

SEQ ID NO: 1687 - DNA, 10 bp, Artificial Sequence
  Synthetic Polynucleotide
accgaaaacg

SEQ ID NO: 1688 - DNA, 10 bp, Artificial Sequence
  Synthetic Polynucleotide
cccagtgttc

SEQ ID NO: 1689 - DNA, 10 bp, Artificial Sequence
  Synthetic Polynucleotide
tgcagatggc

SEQ ID NO: 1690 - DNA, 10 bp, Artificial Sequence
  Synthetic Polynucleotide
ggtacctcca

SEQ ID NO: 1691 - DNA, 10 bp, Artificial Sequence
  Synthetic Polynucleotide
gaggaggagc

SEQ ID NO: 1692 - DNA, 10 bp, Artificial Sequence
  Synthetic Polynucleotide
tagggtctgg

SEQ ID NO: 1693 - DNA, 10 bp, Artificial Sequence
  Synthetic Polynucleotide
ctgcagccaa

SEQ ID NO: 1694 - DNA, 10 bp, Artificial Sequence
  Synthetic Polynucleotide
ggtgcaatgg

SEQ ID NO: 1695 - DNA, 10 bp, Artificial Sequence
  Synthetic Polynucleotide
tatgcccact

SEQ ID NO: 1696 - DNA, 10 bp, Artificial Sequence
  Synthetic Polynucleotide
ccagagtgga

SEQ ID NO: 1697 - DNA, 10 bp, Artificial Sequence
  Synthetic Polynucleotide
tccggtccac

SEQ ID NO: 1698 - DNA, 10 bp, Artificial Sequence
  Synthetic Polynucleotide
ccccatcctc

SEQ ID NO: 1699 - DNA, 10 bp, Artificial Sequence
  Synthetic Polynucleotide
caacagcgtc

SEQ ID NO: 1700 - DNA, 10 bp, Artificial Sequence
  Synthetic Polynucleotide
gccaatcctc

SEQ ID NO: 1701 - DNA, 10 bp, Artificial Sequence
  Synthetic Polynucleotide
caccaagtgg

SEQ ID NO: 1702 - DNA, 10 bp, Artificial Sequence
  Synthetic Polynucleotide
ggcgggattt

SEQ ID NO: 1703 - DNA, 10 bp, Artificial Sequence
  Synthetic Polynucleotide
cccctgatgt

SEQ ID NO: 1704 - DNA, 10 bp, Artificial Sequence
  Synthetic Polynucleotide
ccactgggag

SEQ ID NO: 1705 - DNA, 10 bp, Artificial Sequence
  Synthetic Polynucleotide
aggatggtga

SEQ ID NO: 1706 - DNA, 10 bp, Artificial Sequence
  Synthetic Polynucleotide
actgcccaca

SEQ ID NO: 1707 - DNA, 10 bp, Artificial Sequence
  Synthetic Polynucleotide
tgcagatggc

SEQ ID NO: 1708 - DNA, 10 bp, Artificial Sequence
  Synthetic Polynucleotide
ggcgagcata

SEQ ID NO: 1709 - DNA, 10 bp, Artificial Sequence
  Synthetic Polynucleotide
ggctttggtg

SEQ ID NO: 1710 - DNA, 10 bp, Artificial Sequence
  Synthetic Polynucleotide
ggggtgcttg

SEQ ID NO: 1711 - DNA, 10 bp, Artificial Sequence
  Synthetic Polynucleotide
tggaacccat

SEQ ID NO: 1712 - DNA, 10 bp, Artificial Sequence
  Synthetic Polynucleotide
aacaggcgac

SEQ ID NO: 1713 - DNA, 10 bp, Artificial Sequence
  Synthetic Polynucleotide
gaggacgagg

SEQ ID NO: 1714 - DNA, 10 bp, Artificial Sequence
  Synthetic Polynucleotide
ccacttggtg

SEQ ID NO: 1715 - DNA, 10 bp, Artificial Sequence
  Synthetic Polynucleotide
ggctttgggg

SEQ ID NO: 1716 - DNA, 10 bp, Artificial Sequence
  Synthetic Polynucleotide
tgccaatcct

SEQ ID NO: 1717 - DNA, 10 bp, Artificial Sequence
  Synthetic Polynucleotide
gcacaaggtc

SEQ ID NO: 1718 - DNA, 10 bp, Artificial Sequence
  Synthetic Polynucleotide
agttgcagca

SEQ ID NO: 1719 - DNA, 10 bp, Artificial Sequence
  Synthetic Polynucleotide
aggaggagga

SEQ ID NO: 1720 - DNA, 10 bp, Artificial Sequence
  Synthetic Polynucleotide
gggtttgctc

SEQ ID NO: 1721 - DNA, 10 bp, Artificial Sequence
  Synthetic Polynucleotide
aaaatcccgc

SEQ ID NO: 1722 - DNA, 10 bp, Artificial Sequence
  Synthetic Polynucleotide
tgcttagggt

SEQ ID NO: 1723 - DNA, 10 bp, Artificial Sequence
  Synthetic Polynucleotide
gcccttaggt

SEQ ID NO: 1724 - DNA, 10 bp, Artificial Sequence
  Synthetic Polynucleotide
cagcccatac

SEQ ID NO: 1725 - DNA, 10 bp, Artificial Sequence
  Synthetic Polynucleotide
gaccgcctgt

SEQ ID NO: 1726 - DNA, 10 bp, Artificial Sequence
  Synthetic Polynucleotide
gtgctggtcc

SEQ ID NO: 1727 - DNA, 10 bp, Artificial Sequence
  Synthetic Polynucleotide
caggtagggg

SEQ ID NO: 1728 - DNA, 10 bp, Artificial Sequence
  Synthetic Polynucleotide
agaacagcca

SEQ ID NO: 1729 - DNA, 10 bp, Artificial Sequence
  Synthetic Polynucleotide
gaggatgcca

SEQ ID NO: 1730 - DNA, 10 bp, Artificial Sequence
  Synthetic Polynucleotide
cattctccgc

SEQ ID NO: 1731 - DNA, 10 bp, Artificial Sequence
  Synthetic Polynucleotide
aaagggcaca

SEQ ID NO: 1732 - DNA, 10 bp, Artificial Sequence
  Synthetic Polynucleotide
cagcaggttg

SEQ ID NO: 1733 - DNA, 10 bp, Artificial Sequence
  Synthetic Polynucleotide
acaagccaga

SEQ ID NO: 1734 - DNA, 10 bp, Artificial Sequence
  Synthetic Polynucleotide
tgtatgctgc

SEQ ID NO: 1735 - DNA, 10 bp, Artificial Sequence
  Synthetic Polynucleotide
actcatgggg

SEQ ID NO: 1736 - DNA, 10 bp, Artificial Sequence
  Synthetic Polynucleotide
ctctcgtcct

SEQ ID NO: 1737 - DNA, 10 bp, Artificial Sequence
  Synthetic Polynucleotide
agagacggca

SEQ ID NO: 1738 - DNA, 10 bp, Artificial Sequence
  Synthetic Polynucleotide
atcaggagca

SEQ ID NO: 1739 - DNA, 10 bp, Artificial Sequence
  Synthetic Polynucleotide
tccagaggag

SEQ ID NO: 1740 - DNA, 10 bp, Artificial Sequence
  Synthetic Polynucleotide
gggtctctca

SEQ ID NO: 1741 - DNA, 10 bp, Artificial Sequence
  Synthetic Polynucleotide
tgcagtttgg

SEQ ID NO: 1742 - DNA, 10 bp, Artificial Sequence
  Synthetic Polynucleotide
cgttgaccaa

SEQ ID NO: 1743 - DNA, 10 bp, Artificial Sequence
  Synthetic Polynucleotide
aaggagcagg

SEQ ID NO: 1744 - DNA, 10 bp, Artificial Sequence
  Synthetic Polynucleotide
tgcaggatca

SEQ ID NO: 1745 - DNA, 10 bp, Artificial Sequence
  Synthetic Polynucleotide
tggggcaaat

SEQ ID NO: 1746 - DNA, 10 bp, Artificial Sequence
  Synthetic Polynucleotide
tcccttgctg

SEQ ID NO: 1747 - DNA, 10 bp, Artificial Sequence
  Synthetic Polynucleotide
agggatcgga

SEQ ID NO: 1748 - DNA, 10 bp, Artificial Sequence
  Synthetic Polynucleotide
tgcaggagtt

SEQ ID NO: 1749 - DNA, 10 bp, Artificial Sequence
  Synthetic Polynucleotide
aagaggctgc

SEQ ID NO: 1750 - DNA, 10 bp, Artificial Sequence
  Synthetic Polynucleotide
tgcaccactc

SEQ ID NO: 1751 - DNA, 10 bp, Artificial Sequence
  Synthetic Polynucleotide
gcctgggaag

SEQ ID NO: 1752 - DNA, 10 bp, Artificial Sequence
  Synthetic Polynucleotide
tgggtctcct

SEQ ID NO: 1753 - DNA, 10 bp, Artificial Sequence
  Synthetic Polynucleotide
gttcagggtg

SEQ ID NO: 1754 - DNA, 10 bp, Artificial Sequence
  Synthetic Polynucleotide
gctcctctcc

SEQ ID NO: 1755 - DNA, 10 bp, Artificial Sequence
  Synthetic Polynucleotide
atgccgcagc

SEQ ID NO: 1756 - DNA, 10 bp, Artificial Sequence
  Synthetic Polynucleotide
tctgaccaga

SEQ ID NO: 1757 - DNA, 10 bp, Artificial Sequence
  Synthetic Polynucleotide
atgggaggga

SEQ ID NO: 1758 - DNA, 10 bp, Artificial Sequence
  Synthetic Polynucleotide
gctgtcaccc

SEQ ID NO: 1759 - DNA, 10 bp, Artificial Sequence
  Synthetic Polynucleotide
tgcaacaggg

SEQ ID NO: 1760 - DNA, 10 bp, Artificial Sequence
  Synthetic Polynucleotide
gcagtcatgc

SEQ ID NO: 1761 - DNA, 10 bp, Artificial Sequence
  Synthetic Polynucleotide
tcgtccccga

SEQ ID NO: 1762 - DNA, 10 bp, Artificial Sequence
  Synthetic Polynucleotide
tctcagtcgg

SEQ ID NO: 1763 - DNA, 10 bp, Artificial Sequence
  Synthetic Polynucleotide
cggacaaacc

SEQ ID NO: 1764 - DNA, 10 bp, Artificial Sequence
  Synthetic Polynucleotide
tcccacatgg

SEQ ID NO: 1765 - DNA, 10 bp, Artificial Sequence
  Synthetic Polynucleotide
agaagtgcga

SEQ ID NO: 1766 - DNA, 10 bp, Artificial Sequence
  Synthetic Polynucleotide
ggtagacgga

SEQ ID NO: 1767 - DNA, 10 bp, Artificial Sequence
  Synthetic Polynucleotide
atcaacccca

SEQ ID NO: 1768 - DNA, 10 bp, Artificial Sequence
  Synthetic Polynucleotide
gcggttttcg

SEQ ID NO: 1769 - DNA, 10 bp, Artificial Sequence
  Synthetic Polynucleotide
agatgctcgg

SEQ ID NO: 1770 - DNA, 10 bp, Artificial Sequence
  Synthetic Polynucleotide
ctgaaccagc

SEQ ID NO: 1771 - DNA, 10 bp, Artificial Sequence
  Synthetic Polynucleotide
cgccctgctc

SEQ ID NO: 1772 - DNA, 10 bp, Artificial Sequence
  Synthetic Polynucleotide
ttcagtcgcg

SEQ ID NO: 1773 - DNA, 10 bp, Artificial Sequence
  Synthetic Polynucleotide
tcggcacctg

SEQ ID NO: 1774 - DNA, 10 bp, Artificial Sequence
  Synthetic Polynucleotide
accagtcgat

SEQ ID NO: 1775 - DNA, 10 bp, Artificial Sequence
  Synthetic Polynucleotide
cgaatgctgt

SEQ ID NO: 1776 - DNA, 10 bp, Artificial Sequence
  Synthetic Polynucleotide
ccaaagaccg

SEQ ID NO: 1777 - DNA, 10 bp, Artificial Sequence
  Synthetic Polynucleotide
tggctcttgg

SEQ ID NO: 1778 - DNA, 10 bp, Artificial Sequence
  Synthetic Polynucleotide
gcatagacgg

SEQ ID NO: 1779 - DNA, 10 bp, Artificial Sequence
  Synthetic Polynucleotide
gctacccctt

SEQ ID NO: 1780 - DNA, 10 bp, Artificial Sequence
  Synthetic Polynucleotide
cacggttggc

SEQ ID NO: 1781 - DNA, 10 bp, Artificial Sequence
  Synthetic Polynucleotide
tcaccaaggt

SEQ ID NO: 1782 - DNA, 10 bp, Artificial Sequence
  Synthetic Polynucleotide
tcttcacgac

SEQ ID NO: 1783 - DNA, 10 bp, Artificial Sequence
  Synthetic Polynucleotide
cgttcaacgc

SEQ ID NO: 1784 - DNA, 10 bp, Artificial Sequence
  Synthetic Polynucleotide
actctggagg

SEQ ID NO: 1785 - DNA, 10 bp, Artificial Sequence
  Synthetic Polynucleotide
ccctacgcta

SEQ ID NO: 1786 - DNA, 10 bp, Artificial Sequence
  Synthetic Polynucleotide
tcacgagaga

SEQ ID NO: 1787 - DNA, 10 bp, Artificial Sequence
  Synthetic Polynucleotide
tgctccttgg

SEQ ID NO: 1788 - DNA, 10 bp, Artificial Sequence
  Synthetic Polynucleotide
ggtgcaacat

SEQ ID NO: 1789 - DNA, 10 bp, Artificial Sequence
  Synthetic Polynucleotide
gctaagccct

SEQ ID NO: 1790 - DNA, 10 bp, Artificial Sequence
  Synthetic Polynucleotide
ggtacgctcc

SEQ ID NO: 1791 - DNA, 10 bp, Artificial Sequence
  Synthetic Polynucleotide
tttcccagct

SEQ ID NO: 1792 - DNA, 10 bp, Artificial Sequence
  Synthetic Polynucleotide
cgtcaaacga

SEQ ID NO: 1793 - DNA, 10 bp, Artificial Sequence
  Synthetic Polynucleotide
ttcggtcgta

SEQ ID NO: 1794 - DNA, 10 bp, Artificial Sequence
  Synthetic Polynucleotide
tgagcttcgg

SEQ ID NO: 1795 - DNA, 10 bp, Artificial Sequence
  Synthetic Polynucleotide
gcttttccca

SEQ ID NO: 1796 - DNA, 10 bp, Artificial Sequence
  Synthetic Polynucleotide
gtttgggtcg

SEQ ID NO: 1797 - DNA, 10 bp, Artificial Sequence
  Synthetic Polynucleotide
cgcccgatct

SEQ ID NO: 1798 - DNA, 10 bp, Artificial Sequence
  Synthetic Polynucleotide
cggattggcg

SEQ ID NO: 1799 - DNA, 10 bp, Artificial Sequence
  Synthetic Polynucleotide
tcacccgtca

SEQ ID NO: 1800 - DNA, 10 bp, Artificial Sequence
  Synthetic Polynucleotide
aatggctcgc

SEQ ID NO: 1801 - DNA, 10 bp, Artificial Sequence
  Synthetic Polynucleotide
ccggtgttcc

SEQ ID NO: 1802 - DNA, 10 bp, Artificial Sequence
  Synthetic Polynucleotide
agcagcactc

SEQ ID NO: 1803 - DNA, 10 bp, Artificial Sequence
  Synthetic Polynucleotide
tcatgcctct

SEQ ID NO: 1804 - DNA, 10 bp, Artificial Sequence
  Synthetic Polynucleotide
tacggcacca

SEQ ID NO: 1805 - DNA, 10 bp, Artificial Sequence
  Synthetic Polynucleotide
gcttcctgtc

SEQ ID NO: 1806 - DNA, 10 bp, Artificial Sequence
  Synthetic Polynucleotide
tctccttggt

SEQ ID NO: 1807 - DNA, 10 bp, Artificial Sequence
  Synthetic Polynucleotide
gtgcttggtt

SEQ ID NO: 1808 - DNA, 10 bp, Artificial Sequence
  Synthetic Polynucleotide
taggctgtct

SEQ ID NO: 1809 - DNA, 10 bp, Artificial Sequence
  Synthetic Polynucleotide
atcagccacc

SEQ ID NO: 1810 - DNA, 10 bp, Artificial Sequence
  Synthetic Polynucleotide
ggcagtggaa

SEQ ID NO: 1811 - DNA, 10 bp, Artificial Sequence
  Synthetic Polynucleotide
gcattgcgat

SEQ ID NO: 1812 - DNA, 10 bp, Artificial Sequence
  Synthetic Polynucleotide
gcttgtcctc

SEQ ID NO: 1813 - DNA, 10 bp, Artificial Sequence
  Synthetic Polynucleotide
gaagcaggac

SEQ ID NO: 1814 - DNA, 10 bp, Artificial Sequence
  Synthetic Polynucleotide
ggtcttcgga

SEQ ID NO: 1815 - DNA, 10 bp, Artificial Sequence
  Synthetic Polynucleotide
gtcgtcgtcg

SEQ ID NO: 1816 - DNA, 10 bp, Artificial Sequence
  Synthetic Polynucleotide
cctcccacca

SEQ ID NO: 1817 - DNA, 10 bp, Artificial Sequence
  Synthetic Polynucleotide
atcaaggccg

SEQ ID NO: 1818 - DNA, 10 bp, Artificial Sequence
  Synthetic Polynucleotide
tcccacccac

SEQ ID NO: 1819 - DNA, 10 bp, Artificial Sequence
  Synthetic Polynucleotide
ctttgccggg

SEQ ID NO: 1820 - DNA, 10 bp, Artificial Sequence
  Synthetic Polynucleotide
acgcctcaaa

SEQ ID NO: 1821 - DNA, 10 bp, Artificial Sequence
  Synthetic Polynucleotide
gcttaccacc

SEQ ID NO: 1822 - DNA, 10 bp, Artificial Sequence
  Synthetic Polynucleotide
ctcctccagc

SEQ ID NO: 1823 - DNA, 10 bp, Artificial Sequence
  Synthetic Polynucleotide
aaaagagcgc

SEQ ID NO: 1824 - DNA, 10 bp, Artificial Sequence
  Synthetic Polynucleotide
tcgataccgt

SEQ ID NO: 1825 - DNA, 10 bp, Artificial Sequence
  Synthetic Polynucleotide
ccacatccac

SEQ ID NO: 1826 - DNA, 10 bp, Artificial Sequence
  Synthetic Polynucleotide
gtggcggtgt

SEQ ID NO: 1827 - DNA, 10 bp, Artificial Sequence
  Synthetic Polynucleotide
gcttggagca

SEQ ID NO: 1828 - DNA, 10 bp, Artificial Sequence
  Synthetic Polynucleotide
ctggggcggt

SEQ ID NO: 1829 - DNA, 10 bp, Artificial Sequence
  Synthetic Polynucleotide
gggcggtata

SEQ ID NO: 1830 - DNA, 10 bp, Artificial Sequence
  Synthetic Polynucleotide
aatctgcgac

SEQ ID NO: 1831 - DNA, 10 bp, Artificial Sequence
  Synthetic Polynucleotide
atgcgaaccg

SEQ ID NO: 1832 - DNA, 10 bp, Artificial Sequence
  Synthetic Polynucleotide
gctgttggag

SEQ ID NO: 1833 - DNA, 10 bp, Artificial Sequence
  Synthetic Polynucleotide
tcctcctcca

SEQ ID NO: 1834 - DNA, 10 bp, Artificial Sequence
  Synthetic Polynucleotide
tgtggtgttg

SEQ ID NO: 1835 - DNA, 10 bp, Artificial Sequence
  Synthetic Polynucleotide
tgcaacgagt

SEQ ID NO: 1836 - DNA, 10 bp, Artificial Sequence
  Synthetic Polynucleotide
ctcctcctgt

SEQ ID NO: 1837 - DNA, 10 bp, Artificial Sequence
  Synthetic Polynucleotide
tgctagtggg

SEQ ID NO: 1838 - DNA, 10 bp, Artificial Sequence
  Synthetic Polynucleotide
ggatcgttcc

SEQ ID NO: 1839 - DNA, 10 bp, Artificial Sequence
  Synthetic Polynucleotide
tatgcgagta

SEQ ID NO: 1840 - DNA, 10 bp, Artificial Sequence
  Synthetic Polynucleotide
acaaaacgcc

SEQ ID NO: 1841 - DNA, 10 bp, Artificial Sequence
  Synthetic Polynucleotide
gcaaacctga

SEQ ID NO: 1842 - DNA, 10 bp, Artificial Sequence
  Synthetic Polynucleotide
acttgccgtt

SEQ ID NO: 1843 - DNA, 10 bp, Artificial Sequence
  Synthetic Polynucleotide
aatgtcagcg

SEQ ID NO: 1844 - DNA, 10 bp, Artificial Sequence
  Synthetic Polynucleotide
ctgccaccac

SEQ ID NO: 1845 - DNA, 10 bp, Artificial Sequence
  Synthetic Polynucleotide
cctctgtccg

SEQ ID NO: 1846 - DNA, 10 bp, Artificial Sequence
  Synthetic Polynucleotide
gtcggttccg

SEQ ID NO: 1847 - DNA, 10 bp, Artificial Sequence
  Synthetic Polynucleotide
tccggcccct

SEQ ID NO: 1848 - DNA, 10 bp, Artificial Sequence
  Synthetic Polynucleotide
ggcgttcacc

SEQ ID NO: 1849 - DNA, 10 bp, Artificial Sequence
  Synthetic Polynucleotide
gccgtgggac

SEQ ID NO: 1850 - DNA, 10 bp, Artificial Sequence
  Synthetic Polynucleotide
accttctggg

SEQ ID NO: 1851 - DNA, 10 bp, Artificial Sequence
  Synthetic Polynucleotide
ggccaaaagc

SEQ ID NO: 1852 - DNA, 10 bp, Artificial Sequence
  Synthetic Polynucleotide
cagccctgac

SEQ ID NO: 1853 - DNA, 10 bp, Artificial Sequence
  Synthetic Polynucleotide
cctcaccgcc

SEQ ID NO: 1854 - DNA, 10 bp, Artificial Sequence
  Synthetic Polynucleotide
ggtcgagttg

SEQ ID NO: 1855 - DNA, 10 bp, Artificial Sequence
  Synthetic Polynucleotide
cagtgttgct

SEQ ID NO: 1856 - DNA, 10 bp, Artificial Sequence
  Synthetic Polynucleotide
ccatgttgcc

SEQ ID NO: 1857 - DNA, 10 bp, Artificial Sequence
  Synthetic Polynucleotide
gggttccgct

SEQ ID NO: 1858 - DNA, 10 bp, Artificial Sequence
  Synthetic Polynucleotide
cgtggttgga

SEQ ID NO: 1859 - DNA, 10 bp, Artificial Sequence
  Synthetic Polynucleotide
ggacacccaa

SEQ ID NO: 1860 - DNA, 10 bp, Artificial Sequence
  Synthetic Polynucleotide
tctgttccgc

SEQ ID NO: 1861 - DNA, 10 bp, Artificial Sequence
  Synthetic Polynucleotide
cgcctgtttt

SEQ ID NO: 1862 - DNA, 10 bp, Artificial Sequence
  Synthetic Polynucleotide
gggcatcctt

SEQ ID NO: 1863 - DNA, 10 bp, Artificial Sequence
  Synthetic Polynucleotide
gccgaaagcc

SEQ ID NO: 1864 - DNA, 10 bp, Artificial Sequence
  Synthetic Polynucleotide
ccgaggagca

SEQ ID NO: 1865 - DNA, 10 bp, Artificial Sequence
  Synthetic Polynucleotide
tacccctgga

SEQ ID NO: 1866 - DNA, 10 bp, Artificial Sequence
  Synthetic Polynucleotide
ccaccaacct

SEQ ID NO: 1867 - DNA, 10 bp, Artificial Sequence
  Synthetic Polynucleotide
tgtgccaaag

SEQ ID NO: 1868 - DNA, 10 bp, Artificial Sequence
  Synthetic Polynucleotide
tcaccaacca

SEQ ID NO: 1869 - DNA, 10 bp, Artificial Sequence
  Synthetic Polynucleotide
caacctgcca

SEQ ID NO: 1870 - DNA, 10 bp, Artificial Sequence
  Synthetic Polynucleotide
tccactgagt

SEQ ID NO: 1871 - DNA, 10 bp, Artificial Sequence
  Synthetic Polynucleotide
atgccagcaa

SEQ ID NO: 1872 - DNA, 10 bp, Artificial Sequence
  Synthetic Polynucleotide
ccctgatgga

SEQ ID NO: 1873 - DNA, 10 bp, Artificial Sequence
  Synthetic Polynucleotide
ccaggtccct

SEQ ID NO: 1874 - DNA, 10 bp, Artificial Sequence
  Synthetic Polynucleotide
ccattgtgcc

SEQ ID NO: 1875 - DNA, 10 bp, Artificial Sequence
  Synthetic Polynucleotide
tgccagcttg

SEQ ID NO: 1876 - DNA, 10 bp, Artificial Sequence
  Synthetic Polynucleotide
tgtcgccaag

SEQ ID NO: 1877 - DNA, 10 bp, Artificial Sequence
  Synthetic Polynucleotide
tggctccacg

SEQ ID NO: 1878 - DNA, 10 bp, Artificial Sequence
  Synthetic Polynucleotide
aacccatgcc

SEQ ID NO: 1879 - DNA, 10 bp, Artificial Sequence
  Synthetic Polynucleotide
agccctcaac

SEQ ID NO: 1880 - DNA, 10 bp, Artificial Sequence
  Synthetic Polynucleotide
accttgggct

SEQ ID NO: 1881 - DNA, 10 bp, Artificial Sequence
  Synthetic Polynucleotide
atacacccgt

SEQ ID NO: 1882 - DNA, 10 bp, Artificial Sequence
  Synthetic Polynucleotide
tctcacgggc

SEQ ID NO: 1883 - DNA, 10 bp, Artificial Sequence
  Synthetic Polynucleotide
ttggtgctgg

SEQ ID NO: 1884 - DNA, 10 bp, Artificial Sequence
  Synthetic Polynucleotide
ctctccggta

SEQ ID NO: 1885 - DNA, 10 bp, Artificial Sequence
  Synthetic Polynucleotide
gcatccagtg

SEQ ID NO: 1886 - DNA, 10 bp, Artificial Sequence
  Synthetic Polynucleotide
ttgccgatga

SEQ ID NO: 1887 - DNA, 10 bp, Artificial Sequence
  Synthetic Polynucleotide
gccctggaag

SEQ ID NO: 1888 - DNA, 10 bp, Artificial Sequence
  Synthetic Polynucleotide
tggcatcctt

SEQ ID NO: 1889 - DNA, 10 bp, Artificial Sequence
  Synthetic Polynucleotide
tgagccatgt

SEQ ID NO: 1890 - DNA, 10 bp, Artificial Sequence
  Synthetic Polynucleotide
tctgaccacc

SEQ ID NO: 1891 - DNA, 10 bp, Artificial Sequence
  Synthetic Polynucleotide
tgccgcaggt

SEQ ID NO: 1892 - DNA, 10 bp, Artificial Sequence
  Synthetic Polynucleotide
tcccactcaa

SEQ ID NO: 1893 - DNA, 10 bp, Artificial Sequence
  Synthetic Polynucleotide
ggtgctggcg

SEQ ID NO: 1894 - DNA, 10 bp, Artificial Sequence
  Synthetic Polynucleotide
cgatgtcctg

SEQ ID NO: 1895 - DNA, 10 bp, Artificial Sequence
  Synthetic Polynucleotide
ccagttgcag

SEQ ID NO: 1896 - DNA, 10 bp, Artificial Sequence
  Synthetic Polynucleotide
tcaagggtga

SEQ ID NO: 1897 - DNA, 10 bp, Artificial Sequence
  Synthetic Polynucleotide
taaacggtgg

SEQ ID NO: 1898 - DNA, 10 bp, Artificial Sequence
  Synthetic Polynucleotide
acaacaagcc

SEQ ID NO: 1899 - DNA, 10 bp, Artificial Sequence
  Synthetic Polynucleotide
gcagttggac

SEQ ID NO: 1900 - DNA, 10 bp, Artificial Sequence
  Synthetic Polynucleotide
agcttcacca

SEQ ID NO: 1901 - DNA, 10 bp, Artificial Sequence
  Synthetic Polynucleotide
tgaacaacga

SEQ ID NO: 1902 - DNA, 10 bp, Artificial Sequence
  Synthetic Polynucleotide
tttacccgct

SEQ ID NO: 1903 - DNA, 10 bp, Artificial Sequence
  Synthetic Polynucleotide
cgtgggcttg

SEQ ID NO: 1904 - DNA, 10 bp, Artificial Sequence
  Synthetic Polynucleotide
tgcagcgtct

SEQ ID NO: 1905 - DNA, 10 bp, Artificial Sequence
  Synthetic Polynucleotide
acccagacgc

SEQ ID NO: 1906 - DNA, 10 bp, Artificial Sequence
  Synthetic Polynucleotide
gccgcatgaa

SEQ ID NO: 1907 - DNA, 10 bp, Artificial Sequence
  Synthetic Polynucleotide
gaagactggc

SEQ ID NO: 1908 - DNA, 10 bp, Artificial Sequence
  Synthetic Polynucleotide
acaatggcac

SEQ ID NO: 1909 - DNA, 10 bp, Artificial Sequence
  Synthetic Polynucleotide
tcctgcttct

SEQ ID NO: 1910 - DNA, 10 bp, Artificial Sequence
  Synthetic Polynucleotide
gctggcgtaa

SEQ ID NO: 1911 - DNA, 10 bp, Artificial Sequence
  Synthetic Polynucleotide
gcagcaacaa

SEQ ID NO: 1912 - DNA, 10 bp, Artificial Sequence
  Synthetic Polynucleotide
caatctggca

SEQ ID NO: 1913 - DNA, 10 bp, Artificial Sequence
  Synthetic Polynucleotide
tctcctcctg

SEQ ID NO: 1914 - DNA, 10 bp, Artificial Sequence
  Synthetic Polynucleotide
gcttgaacca

SEQ ID NO: 1915 - DNA, 10 bp, Artificial Sequence
  Synthetic Polynucleotide
actgcgttct

SEQ ID NO: 1916 - DNA, 10 bp, Artificial Sequence
  Synthetic Polynucleotide
tggctgtggt

SEQ ID NO: 1917 - DNA, 10 bp, Artificial Sequence
  Synthetic Polynucleotide
tgtggcgggt

SEQ ID NO: 1918 - DNA, 10 bp, Artificial Sequence
  Synthetic Polynucleotide
tgtggcgagt

SEQ ID NO: 1919 - DNA, 10 bp, Artificial Sequence
  Synthetic Polynucleotide
tgccgtggtc

SEQ ID NO: 1920 - DNA, 10 bp, Artificial Sequence
  Synthetic Polynucleotide
taggcttgta

SEQ ID NO: 1921 - DNA, 10 bp, Artificial Sequence
  Synthetic Polynucleotide
tccaacgagc

SEQ ID NO: 1922 - DNA, 10 bp, Artificial Sequence
  Synthetic Polynucleotide
ggctgtggta

SEQ ID NO: 1923 - DNA, 10 bp, Artificial Sequence
  Synthetic Polynucleotide
ccaacgagtc

SEQ ID NO: 1924 - DNA, 10 bp, Artificial Sequence
  Synthetic Polynucleotide
tgtgaagcgg

SEQ ID NO: 1925 - DNA, 10 bp, Artificial Sequence
  Synthetic Polynucleotide
agtccgagct

SEQ ID NO: 1926 - DNA, 10 bp, Artificial Sequence
  Synthetic Polynucleotide
tgtggcgagc

SEQ ID NO: 1927 - DNA, 10 bp, Artificial Sequence
  Synthetic Polynucleotide
tggcgggtgt

SEQ ID NO: 1928 - DNA, 10 bp, Artificial Sequence
  Synthetic Polynucleotide
agtgtggcag

SEQ ID NO: 1929 - DNA, 10 bp, Artificial Sequence
  Synthetic Polynucleotide
tagcacttga

SEQ ID NO: 1930 - DNA, 10 bp, Artificial Sequence
  Synthetic Polynucleotide
acgagcactg

SEQ ID NO: 1931 - DNA, 10 bp, Artificial Sequence
  Synthetic Polynucleotide
ccgaaagtga

SEQ ID NO: 1932 - DNA, 10 bp, Artificial Sequence
  Synthetic Polynucleotide
cattgctgga

SEQ ID NO: 1933 - DNA, 10 bp, Artificial Sequence
  Synthetic Polynucleotide
tacttgctga

SEQ ID NO: 1934 - DNA, 10 bp, Artificial Sequence
  Synthetic Polynucleotide
actttgcgtt

SEQ ID NO: 1935 - DNA, 10 bp, Artificial Sequence
  Synthetic Polynucleotide
accagaacca

SEQ ID NO: 1936 - DNA, 10 bp, Artificial Sequence
  Synthetic Polynucleotide
gggaaggagg

SEQ ID NO: 1937 - DNA, 10 bp, Artificial Sequence
  Synthetic Polynucleotide
aaacgggact

SEQ ID NO: 1938 - DNA, 10 bp, Artificial Sequence
  Synthetic Polynucleotide
aacgttgcag

SEQ ID NO: 1939 - DNA, 10 bp, Artificial Sequence
  Synthetic Polynucleotide
ttcggcttga

SEQ ID NO: 1940 - DNA, 10 bp, Artificial Sequence
  Synthetic Polynucleotide
acagccacga

SEQ ID NO: 1941 - DNA, 10 bp, Artificial Sequence
  Synthetic Polynucleotide
ttttgcgaca

SEQ ID NO: 1942 - DNA, 10 bp, Artificial Sequence
  Synthetic Polynucleotide
acgttcttcg

SEQ ID NO: 1943 - DNA, 10 bp, Artificial Sequence
  Synthetic Polynucleotide
tggttgcagt

SEQ ID NO: 1944 - DNA, 10 bp, Artificial Sequence
  Synthetic Polynucleotide
acacgtcacg

SEQ ID NO: 1945 - DNA, 10 bp, Artificial Sequence
  Synthetic Polynucleotide
gcgaacacaa

SEQ ID NO: 1946 - DNA, 10 bp, Artificial Sequence
  Synthetic Polynucleotide
cttcacgctg

SEQ ID NO: 1947 - DNA, 10 bp, Artificial Sequence
  Synthetic Polynucleotide
cacacactga

SEQ ID NO: 1948 - DNA, 10 bp, Artificial Sequence
  Synthetic Polynucleotide
ttcgtcagct

SEQ ID NO: 1949 - DNA, 10 bp, Artificial Sequence
  Synthetic Polynucleotide
cacggagcag

SEQ ID NO: 1950 - DNA, 10 bp, Artificial Sequence
  Synthetic Polynucleotide
tccatttgca

SEQ ID NO: 1951 - DNA, 10 bp, Artificial Sequence
  Synthetic Polynucleotide
gtttggcaga

SEQ ID NO: 1952 - DNA, 10 bp, Artificial Sequence
  Synthetic Polynucleotide
cacagcacaa

SEQ ID NO: 1953 - DNA, 10 bp, Artificial Sequence
  Synthetic Polynucleotide
aaacccacgt

SEQ ID NO: 1954 - DNA, 10 bp, Artificial Sequence
  Synthetic Polynucleotide
tgtggggcaa

SEQ ID NO: 1955 - DNA, 10 bp, Artificial Sequence
  Synthetic Polynucleotide
acgtcgttcc

SEQ ID NO: 1956 - DNA, 10 bp, Artificial Sequence
  Synthetic Polynucleotide
gcacgtacac

SEQ ID NO: 1957 - DNA, 10 bp, Artificial Sequence
  Synthetic Polynucleotide
acaagctgct

SEQ ID NO: 1958 - DNA, 10 bp, Artificial Sequence
  Synthetic Polynucleotide
ccacggattg

SEQ ID NO: 1959 - DNA, 10 bp, Artificial Sequence
  Synthetic Polynucleotide
gaccacgccg

SEQ ID NO: 1960 - DNA, 10 bp, Artificial Sequence
  Synthetic Polynucleotide
agcatcacga

SEQ ID NO: 1961 - DNA, 10 bp, Artificial Sequence
  Synthetic Polynucleotide
gctgcaccac

SEQ ID NO: 1962 - DNA, 10 bp, Artificial Sequence
  Synthetic Polynucleotide
ggcatcatcg

SEQ ID NO: 1963 - DNA, 10 bp, Artificial Sequence
  Synthetic Polynucleotide
gcacgtcttg

SEQ ID NO: 1964 - DNA, 10 bp, Artificial Sequence
  Synthetic Polynucleotide
cgagacttgc

SEQ ID NO: 1965 - DNA, 10 bp, Artificial Sequence
  Synthetic Polynucleotide
aagctgccgt

SEQ ID NO: 1966 - DNA, 10 bp, Artificial Sequence
  Synthetic Polynucleotide
tgccaagcct

SEQ ID NO: 1967 - DNA, 10 bp, Artificial Sequence
  Synthetic Polynucleotide
ccacagccac

SEQ ID NO: 1968 - DNA, 10 bp, Artificial Sequence
  Synthetic Polynucleotide
gaaccacacg

SEQ ID NO: 1969 - DNA, 10 bp, Artificial Sequence
  Synthetic Polynucleotide
gacagttgca

SEQ ID NO: 1970 - DNA, 10 bp, Artificial Sequence
  Synthetic Polynucleotide
accgaagtct

SEQ ID NO: 1971 - DNA, 10 bp, Artificial Sequence
  Synthetic Polynucleotide
acacgtcgtc

SEQ ID NO: 1972 - DNA, 10 bp, Artificial Sequence
  Synthetic Polynucleotide
tgaggtttgc

SEQ ID NO: 1973 - DNA, 10 bp, Artificial Sequence
  Synthetic Polynucleotide
aagccatgca

SEQ ID NO: 1974 - DNA, 10 bp, Artificial Sequence
  Synthetic Polynucleotide
tctgcgaacg

SEQ ID NO: 1975 - DNA, 10 bp, Artificial Sequence
  Synthetic Polynucleotide
acgagaagga

SEQ ID NO: 1976 - DNA, 10 bp, Artificial Sequence
  Synthetic Polynucleotide
cgaaccacgc

SEQ ID NO: 1977 - DNA, 10 bp, Artificial Sequence
  Synthetic Polynucleotide
gcaaagttgc

SEQ ID NO: 1978 - DNA, 10 bp, Artificial Sequence
  Synthetic Polynucleotide
ttgcaaccgg

SEQ ID NO: 1979 - DNA, 10 bp, Artificial Sequence
  Synthetic Polynucleotide
ctgccaaacc

SEQ ID NO: 1980 - DNA, 10 bp, Artificial Sequence
  Synthetic Polynucleotide
agtcgtcgaa

SEQ ID NO: 1981 - DNA, 10 bp, Artificial Sequence
  Synthetic Polynucleotide
tcgtcgagac

SEQ ID NO: 1982 - DNA, 10 bp, Artificial Sequence
  Synthetic Polynucleotide
ctgccacacc

SEQ ID NO: 1983 - DNA, 10 bp, Artificial Sequence
  Synthetic Polynucleotide
tcgctgacgt

SEQ ID NO: 1984 - DNA, 10 bp, Artificial Sequence
  Synthetic Polynucleotide
gcacatgacg

SEQ ID NO: 1985 - DNA, 10 bp, Artificial Sequence
  Synthetic Polynucleotide
cgcaagtacg

SEQ ID NO: 1986 - DNA, 10 bp, Artificial Sequence
  Synthetic Polynucleotide
ccatcgtgca

SEQ ID NO: 1987 - DNA, 10 bp, Artificial Sequence
  Synthetic Polynucleotide
gcaaagctcc

SEQ ID NO: 1988 - DNA, 10 bp, Artificial Sequence
  Synthetic Polynucleotide
gcaggtacac

SEQ ID NO: 1989 - DNA, 10 bp, Artificial Sequence
  Synthetic Polynucleotide
cgcactgaaa

SEQ ID NO: 1990 - DNA, 10 bp, Artificial Sequence
  Synthetic Polynucleotide
gtgcatcgga

SEQ ID NO: 1991 - DNA, 10 bp, Artificial Sequence
  Synthetic Polynucleotide
cgagcaagtg

SEQ ID NO: 1992 - DNA, 10 bp, Artificial Sequence
  Synthetic Polynucleotide
gctcgccaca

SEQ ID NO: 1993 - DNA, 10 bp, Artificial Sequence
  Synthetic Polynucleotide
tcaagcaccc

SEQ ID NO: 1994 - DNA, 10 bp, Artificial Sequence
  Synthetic Polynucleotide
gggctcagaa

SEQ ID NO: 1995 - DNA, 10 bp, Artificial Sequence
  Synthetic Polynucleotide
ctgttttgcg

SEQ ID NO: 1996 - DNA, 10 bp, Artificial Sequence
  Synthetic Polynucleotide
ttgtcgcctt

SEQ ID NO: 1997 - DNA, 10 bp, Artificial Sequence
  Synthetic Polynucleotide
aacgtgcatc

SEQ ID NO: 1998 - DNA, 10 bp, Artificial Sequence
  Synthetic Polynucleotide
acagcgactc

SEQ ID NO: 1999 - DNA, 10 bp, Artificial Sequence
  Synthetic Polynucleotide
cgggtgtttc

SEQ ID NO: 2000 - DNA, 10 bp, Artificial Sequence
  Synthetic Polynucleotide
tgacgaccga

SEQ ID NO: 2001 - DNA, 10 bp, Artificial Sequence
  Synthetic Polynucleotide
aagtccggtt

SEQ ID NO: 2002 - DNA, 10 bp, Artificial Sequence
  Synthetic Polynucleotide
tgggttgtga

SEQ ID NO: 2003 - DNA, 10 bp, Artificial Sequence
  Synthetic Polynucleotide
ctctcgggat

SEQ ID NO: 2004 - DNA, 10 bp, Artificial Sequence
  Synthetic Polynucleotide
cgacgtgcct

SEQ ID NO: 2005 - DNA, 10 bp, Artificial Sequence
  Synthetic Polynucleotide
ttcgcaaaga

SEQ ID NO: 2006 - DNA, 10 bp, Artificial Sequence
  Synthetic Polynucleotide
gtgggttcgt

SEQ ID NO: 2007 - DNA, 10 bp, Artificial Sequence
  Synthetic Polynucleotide
cgcgtggtaa

SEQ ID NO: 2008 - DNA, 10 bp, Artificial Sequence
  Synthetic Polynucleotide
ttcgcagcat

SEQ ID NO: 2009 - DNA, 10 bp, Artificial Sequence
  Synthetic Polynucleotide
aaccagtgcc

SEQ ID NO: 2010 - DNA, 10 bp, Artificial Sequence
  Synthetic Polynucleotide
tagaacgtgc

SEQ ID NO: 2011 - DNA, 10 bp, Artificial Sequence
  Synthetic Polynucleotide
gtcattggca

SEQ ID NO: 2012 - DNA, 10 bp, Artificial Sequence
  Synthetic Polynucleotide
ccagcgtgaa

SEQ ID NO: 2013 - DNA, 10 bp, Artificial Sequence
  Synthetic Polynucleotide
catcttcgca

SEQ ID NO: 2014 - DNA, 10 bp, Artificial Sequence
  Synthetic Polynucleotide
agcaacggaa

SEQ ID NO: 2015 - DNA, 10 bp, Artificial Sequence
  Synthetic Polynucleotide
gctgaggagc

SEQ ID NO: 2016 - DNA, 10 bp, Artificial Sequence
  Synthetic Polynucleotide
tgttggacgc

SEQ ID NO: 2017 - DNA, 10 bp, Artificial Sequence
  Synthetic Polynucleotide
tggcacgggc

SEQ ID NO: 2018 - DNA, 10 bp, Artificial Sequence
  Synthetic Polynucleotide
ttgtggcgaa

SEQ ID NO: 2019 - DNA, 10 bp, Artificial Sequence
  Synthetic Polynucleotide
cgatgcagca

SEQ ID NO: 2020 - DNA, 10 bp, Artificial Sequence
  Synthetic Polynucleotide
atgtggcgat

SEQ ID NO: 2021 - DNA, 10 bp, Artificial Sequence
  Synthetic Polynucleotide
aattgcgtca

SEQ ID NO: 2022 - DNA, 10 bp, Artificial Sequence
  Synthetic Polynucleotide
acacactgct

SEQ ID NO: 2023 - DNA, 10 bp, Artificial Sequence
  Synthetic Polynucleotide
gttcacacgt

SEQ ID NO: 2024 - DNA, 10 bp, Artificial Sequence
  Synthetic Polynucleotide
gcaagtctcg

SEQ ID NO: 2025 - DNA, 10 bp, Artificial Sequence
  Synthetic Polynucleotide
cttgtgtcga

SEQ ID NO: 2026 - DNA, 10 bp, Artificial Sequence
  Synthetic Polynucleotide
cgttgactgt

SEQ ID NO: 2027 - DNA, 10 bp, Artificial Sequence
  Synthetic Polynucleotide
ttctcgtggc

SEQ ID NO: 2028 - DNA, 10 bp, Artificial Sequence
  Synthetic Polynucleotide
tggcgggtta

SEQ ID NO: 2029 - DNA, 10 bp, Artificial Sequence
  Synthetic Polynucleotide
tcaaccacct

SEQ ID NO: 2030 - DNA, 10 bp, Artificial Sequence
  Synthetic Polynucleotide
ctgtcacgta

SEQ ID NO: 2031 - DNA, 10 bp, Artificial Sequence
  Synthetic Polynucleotide
gcaatgtcca

SEQ ID NO: 2032 - DNA, 10 bp, Artificial Sequence
  Synthetic Polynucleotide
tgtagcgact

SEQ ID NO: 2033 - DNA, 10 bp, Artificial Sequence
  Synthetic Polynucleotide
gtagccgagt

SEQ ID NO: 2034 - DNA, 10 bp, Artificial Sequence
  Synthetic Polynucleotide
gctcgatggt

SEQ ID NO: 2035 - DNA, 10 bp, Artificial Sequence
  Synthetic Polynucleotide
tcacggtcat

SEQ ID NO: 2036 - DNA, 10 bp, Artificial Sequence
  Synthetic Polynucleotide
cgtagtcacg

SEQ ID NO: 2037 - DNA, 10 bp, Artificial Sequence
  Synthetic Polynucleotide
gttcgccaat

SEQ ID NO: 2038 - DNA, 10 bp, Artificial Sequence
  Synthetic Polynucleotide
ccactgcgta

SEQ ID NO: 2039 - DNA, 10 bp, Artificial Sequence
  Synthetic Polynucleotide
ttgctgtccg

SEQ ID NO: 2040 - DNA, 10 bp, Artificial Sequence
  Synthetic Polynucleotide
cgcacatgtt

SEQ ID NO: 2041 - DNA, 10 bp, Artificial Sequence
  Synthetic Polynucleotide
gcagcggcag

SEQ ID NO: 2042 - DNA, 10 bp, Artificial Sequence
  Synthetic Polynucleotide
tccaatgacg

SEQ ID NO: 2043 - DNA, 10 bp, Artificial Sequence
  Synthetic Polynucleotide
cgagcaagtg

SEQ ID NO: 2044 - DNA, 10 bp, Artificial Sequence
  Synthetic Polynucleotide
ggggtacgtt

SEQ ID NO: 2045 - DNA, 10 bp, Artificial Sequence
  Synthetic Polynucleotide
cacaaaccgt

SEQ ID NO: 2046 - DNA, 10 bp, Artificial Sequence
  Synthetic Polynucleotide
tcgagcacgg

SEQ ID NO: 2047 - DNA, 10 bp, Artificial Sequence
  Synthetic Polynucleotide
taccgtctca

SEQ ID NO: 2048 - DNA, 10 bp, Artificial Sequence
  Synthetic Polynucleotide
gactcggcaa

SEQ ID NO: 2049 - DNA, 10 bp, Artificial Sequence
  Synthetic Polynucleotide
cggacctgac

SEQ ID NO: 2050 - DNA, 10 bp, Artificial Sequence
  Synthetic Polynucleotide
gcggctacgc

SEQ ID NO: 2051 - DNA, 10 bp, Artificial Sequence
  Synthetic Polynucleotide
gacagtacgc

SEQ ID NO: 2052 - DNA, 10 bp, Artificial Sequence
  Synthetic Polynucleotide
cgaagacacg

SEQ ID NO: 2053 - DNA, 10 bp, Artificial Sequence
  Synthetic Polynucleotide
aggagcatgt

SEQ ID NO: 2054 - DNA, 10 bp, Artificial Sequence
  Synthetic Polynucleotide
ttgcaagtgc

SEQ ID NO: 2055 - DNA, 10 bp, Artificial Sequence
  Synthetic Polynucleotide
ttctgcacca

SEQ ID NO: 2056 - DNA, 10 bp, Artificial Sequence
  Synthetic Polynucleotide
ccgtcaacaa

SEQ ID NO: 2057 - DNA, 10 bp, Artificial Sequence
  Synthetic Polynucleotide
tgctggtcac

SEQ ID NO: 2058 - DNA, 10 bp, Artificial Sequence
  Synthetic Polynucleotide
cgctgacgct

SEQ ID NO: 2059 - DNA, 10 bp, Artificial Sequence
  Synthetic Polynucleotide
ggagaagccg

SEQ ID NO: 2060 - DNA, 10 bp, Artificial Sequence
  Synthetic Polynucleotide
ggagcccgca

SEQ ID NO: 2061 - DNA, 10 bp, Artificial Sequence
  Synthetic Polynucleotide
tcgttgctgt

SEQ ID NO: 2062 - DNA, 10 bp, Artificial Sequence
  Synthetic Polynucleotide
gtcgtgatga

SEQ ID NO: 2063 - DNA, 10 bp, Artificial Sequence
  Synthetic Polynucleotide
gttgggaacc

SEQ ID NO: 2064 - DNA, 10 bp, Artificial Sequence
  Synthetic Polynucleotide
agccctgcat

SEQ ID NO: 2065 - DNA, 10 bp, Artificial Sequence
  Synthetic Polynucleotide
atgtgagcca

SEQ ID NO: 2066 - DNA, 10 bp, Artificial Sequence
  Synthetic Polynucleotide
tctgagccca

SEQ ID NO: 2067 - DNA, 10 bp, Artificial Sequence
  Synthetic Polynucleotide
ttcgttgcta

SEQ ID NO: 2068 - DNA, 10 bp, Artificial Sequence
  Synthetic Polynucleotide
ttgtcccagg

SEQ ID NO: 2069 - DNA, 10 bp, Artificial Sequence
  Synthetic Polynucleotide
tggcgagtgt

SEQ ID NO: 2070 - DNA, 10 bp, Artificial Sequence
  Synthetic Polynucleotide
accagccact

SEQ ID NO: 2071 - DNA, 10 bp, Artificial Sequence
  Synthetic Polynucleotide
acgtgaggtg

SEQ ID NO: 2072 - DNA, 10 bp, Artificial Sequence
  Synthetic Polynucleotide
tcctcgtcct

SEQ ID NO: 2073 - DNA, 10 bp, Artificial Sequence
  Synthetic Polynucleotide
ttcgtgatgc

SEQ ID NO: 2074 - DNA, 10 bp, Artificial Sequence
  Synthetic Polynucleotide
tcccgtggag

SEQ ID NO: 2075 - DNA, 10 bp, Artificial Sequence
  Synthetic Polynucleotide
gaagccatga

SEQ ID NO: 2076 - DNA, 10 bp, Artificial Sequence
  Synthetic Polynucleotide
gtgtaacgcg

SEQ ID NO: 2077 - DNA, 10 bp, Artificial Sequence
  Synthetic Polynucleotide
cagccacatc

SEQ ID NO: 2078 - DNA, 10 bp, Artificial Sequence
  Synthetic Polynucleotide
gcacccgatg

SEQ ID NO: 2079 - DNA, 10 bp, Artificial Sequence
  Synthetic Polynucleotide
ccgagacacg

SEQ ID NO: 2080 - DNA, 10 bp, Artificial Sequence
  Synthetic Polynucleotide
ccatcagcgt

SEQ ID NO: 2081 - DNA, 10 bp, Artificial Sequence
  Synthetic Polynucleotide
ctgcggtgtg

SEQ ID NO: 2082 - DNA, 10 bp, Artificial Sequence
  Synthetic Polynucleotide
gggagcaata

SEQ ID NO: 2083 - DNA, 10 bp, Artificial Sequence
  Synthetic Polynucleotide
tccgtccctg

SEQ ID NO: 2084 - DNA, 10 bp, Artificial Sequence
  Synthetic Polynucleotide
tcgatgcgaa

SEQ ID NO: 2085 - DNA, 10 bp, Artificial Sequence
  Synthetic Polynucleotide
cgctagttcc

SEQ ID NO: 2086 - DNA, 10 bp, Artificial Sequence
  Synthetic Polynucleotide
cgaccctcac

SEQ ID NO: 2087 - DNA, 10 bp, Artificial Sequence
  Synthetic Polynucleotide
cgccgaacat

SEQ ID NO: 2088 - DNA, 10 bp, Artificial Sequence
  Synthetic Polynucleotide
ttggtgaacg

SEQ ID NO: 2089 - DNA, 10 bp, Artificial Sequence
  Synthetic Polynucleotide
agtttgtcgc

SEQ ID NO: 2090 - DNA, 10 bp, Artificial Sequence
  Synthetic Polynucleotide
acacttgggc

SEQ ID NO: 2091 - DNA, 10 bp, Artificial Sequence
  Synthetic Polynucleotide
atcgccttga

SEQ ID NO: 2092 - DNA, 10 bp, Artificial Sequence
  Synthetic Polynucleotide
gcgtccgttt

SEQ ID NO: 2093 - DNA, 10 bp, Artificial Sequence
  Synthetic Polynucleotide
actttccggt

SEQ ID NO: 2094 - DNA, 10 bp, Artificial Sequence
  Synthetic Polynucleotide
tgtaagccgt

SEQ ID NO: 2095 - DNA, 10 bp, Artificial Sequence
  Synthetic Polynucleotide
gatgccagtg

SEQ ID NO: 2096 - DNA, 10 bp, Artificial Sequence
  Synthetic Polynucleotide
caacgtaccg

SEQ ID NO: 2097 - DNA, 10 bp, Artificial Sequence
  Synthetic Polynucleotide
ggccatcttc

SEQ ID NO: 2098 - DNA, 10 bp, Artificial Sequence
  Synthetic Polynucleotide
ctgctcctca

SEQ ID NO: 2099 - DNA, 10 bp, Artificial Sequence
  Synthetic Polynucleotide
cgctgccctt

SEQ ID NO: 2100 - DNA, 10 bp, Artificial Sequence
  Synthetic Polynucleotide
ctcctgggaa

SEQ ID NO: 2101 - DNA, 10 bp, Artificial Sequence
  Synthetic Polynucleotide
aagcctcccc

SEQ ID NO: 2102 - DNA, 10 bp, Artificial Sequence
  Synthetic Polynucleotide
tgtgggaggc

SEQ ID NO: 2103 - DNA, 10 bp, Artificial Sequence
  Synthetic Polynucleotide
gcccatcctg

SEQ ID NO: 2104 - DNA, 10 bp, Artificial Sequence
  Synthetic Polynucleotide
atgagctgca

SEQ ID NO: 2105 - DNA, 10 bp, Artificial Sequence
  Synthetic Polynucleotide
gtaggacccc

SEQ ID NO: 2106 - DNA, 10 bp, Artificial Sequence
  Synthetic Polynucleotide
tgctggagag

SEQ ID NO: 2107 - DNA, 10 bp, Artificial Sequence
  Synthetic Polynucleotide
ctgcttcacc

SEQ ID NO: 2108 - DNA, 10 bp, Artificial Sequence
  Synthetic Polynucleotide
gaccactcct

SEQ ID NO: 2109 - DNA, 10 bp, Artificial Sequence
  Synthetic Polynucleotide
actgctctgt

SEQ ID NO: 2110 - DNA, 10 bp, Artificial Sequence
  Synthetic Polynucleotide
ggcacttgcc

SEQ ID NO: 2111 - DNA, 10 bp, Artificial Sequence
  Synthetic Polynucleotide
gtgacacctg

SEQ ID NO: 2112 - DNA, 10 bp, Artificial Sequence
  Synthetic Polynucleotide
ggccttgcaa

SEQ ID NO: 2113 - DNA, 10 bp, Artificial Sequence
  Synthetic Polynucleotide
tggacttggc

SEQ ID NO: 2114 - DNA, 10 bp, Artificial Sequence
  Synthetic Polynucleotide
tattgctgga

SEQ ID NO: 2115 - DNA, 10 bp, Artificial Sequence
  Synthetic Polynucleotide
accaaacgct

SEQ ID NO: 2116 - DNA, 10 bp, Artificial Sequence
  Synthetic Polynucleotide
caggaaagcc

SEQ ID NO: 2117 - DNA, 10 bp, Artificial Sequence
  Synthetic Polynucleotide
tatcgtggca

SEQ ID NO: 2118 - DNA, 10 bp, Artificial Sequence
  Synthetic Polynucleotide
ggtgcattga

SEQ ID NO: 2119 - DNA, 10 bp, Artificial Sequence
  Synthetic Polynucleotide
cccaaccacc

SEQ ID NO: 2120 - DNA, 10 bp, Artificial Sequence
  Synthetic Polynucleotide
tgaaagcagc

SEQ ID NO: 2121 - DNA, 10 bp, Artificial Sequence
  Synthetic Polynucleotide
ccaactgtcc

SEQ ID NO: 2122 - DNA, 10 bp, Artificial Sequence
  Synthetic Polynucleotide
acagcagcac

SEQ ID NO: 2123 - DNA, 10 bp, Artificial Sequence
  Synthetic Polynucleotide
ctctccgtgt

SEQ ID NO: 2124 - DNA, 10 bp, Artificial Sequence
  Synthetic Polynucleotide
tggtttggtg

SEQ ID NO: 2125 - DNA, 10 bp, Artificial Sequence
  Synthetic Polynucleotide
tgttgcgatt

SEQ ID NO: 2126 - DNA, 10 bp, Artificial Sequence
  Synthetic Polynucleotide
cagtgtgcct

SEQ ID NO: 2127 - DNA, 10 bp, Artificial Sequence
  Synthetic Polynucleotide
tacatgccta

SEQ ID NO: 2128 - DNA, 10 bp, Artificial Sequence
  Synthetic Polynucleotide
tgcgtgttct

SEQ ID NO: 2129 - DNA, 10 bp, Artificial Sequence
  Synthetic Polynucleotide
gcgtgtgatt

SEQ ID NO: 2130 - DNA, 10 bp, Artificial Sequence
  Synthetic Polynucleotide
atgcttcagc

SEQ ID NO: 2131 - DNA, 10 bp, Artificial Sequence
  Synthetic Polynucleotide
cataccgtgg

SEQ ID NO: 2132 - DNA, 10 bp, Artificial Sequence
  Synthetic Polynucleotide
gtgtgcctct

SEQ ID NO: 2133 - DNA, 10 bp, Artificial Sequence
  Synthetic Polynucleotide
gccagaacag

SEQ ID NO: 2134 - DNA, 10 bp, Artificial Sequence
  Synthetic Polynucleotide
tgtgacgttc

SEQ ID NO: 2135 - DNA, 10 bp, Artificial Sequence
  Synthetic Polynucleotide
tggatggaga

SEQ ID NO: 2136 - DNA, 10 bp, Artificial Sequence
  Synthetic Polynucleotide
gctgtccact

SEQ ID NO: 2137 - DNA, 10 bp, Artificial Sequence
  Synthetic Polynucleotide
tcacagcagc

SEQ ID NO: 2138 - DNA, 10 bp, Artificial Sequence
  Synthetic Polynucleotide
gcagtatgcc

SEQ ID NO: 2139 - DNA, 10 bp, Artificial Sequence
  Synthetic Polynucleotide
atgagctgga

SEQ ID NO: 2140 - DNA, 10 bp, Artificial Sequence
  Synthetic Polynucleotide
tggtactcgt

SEQ ID NO: 2141 - DNA, 10 bp, Artificial Sequence
  Synthetic Polynucleotide
gggttctgga

SEQ ID NO: 2142 - DNA, 10 bp, Artificial Sequence
  Synthetic Polynucleotide
tgagctttcg

SEQ ID NO: 2143 - DNA, 10 bp, Artificial Sequence
  Synthetic Polynucleotide
gtgttggtga

SEQ ID NO: 2144 - DNA, 10 bp, Artificial Sequence
  Synthetic Polynucleotide
cgtcgagact

SEQ ID NO: 2145 - DNA, 10 bp, Artificial Sequence
  Synthetic Polynucleotide
aagcatcagc

SEQ ID NO: 2146 - DNA, 10 bp, Artificial Sequence
  Synthetic Polynucleotide
catttgcagc

SEQ ID NO: 2147 - DNA, 10 bp, Artificial Sequence
  Synthetic Polynucleotide
caacggaagc

SEQ ID NO: 2148 - DNA, 10 bp, Artificial Sequence
  Synthetic Polynucleotide
tcctcttcgt

SEQ ID NO: 2149 - DNA, 10 bp, Artificial Sequence
  Synthetic Polynucleotide
ccccaaggaa

SEQ ID NO: 2150 - DNA, 10 bp, Artificial Sequence
  Synthetic Polynucleotide
tccccaaaac

SEQ ID NO: 2151 - DNA, 10 bp, Artificial Sequence
  Synthetic Polynucleotide
tgtacgtggc

SEQ ID NO: 2152 - DNA, 10 bp, Artificial Sequence
  Synthetic Polynucleotide
tcgatctggg

SEQ ID NO: 2153 - DNA, 10 bp, Artificial Sequence
  Synthetic Polynucleotide
tggtggcaag

SEQ ID NO: 2154 - DNA, 10 bp, Artificial Sequence
  Synthetic Polynucleotide
ggggtgtgcg

SEQ ID NO: 2155 - DNA, 10 bp, Artificial Sequence
  Synthetic Polynucleotide
gaccactggg

SEQ ID NO: 2156 - DNA, 10 bp, Artificial Sequence
  Synthetic Polynucleotide
agcagttgcg

SEQ ID NO: 2157 - DNA, 10 bp, Artificial Sequence
  Synthetic Polynucleotide
attcgtcgtg

SEQ ID NO: 2158 - DNA, 10 bp, Artificial Sequence
  Synthetic Polynucleotide
gcctggatga

SEQ ID NO: 2159 - DNA, 10 bp, Artificial Sequence
  Synthetic Polynucleotide
tattgcctcc

SEQ ID NO: 2160 - DNA, 10 bp, Artificial Sequence
  Synthetic Polynucleotide
actggttcga

SEQ ID NO: 2161 - DNA, 10 bp, Artificial Sequence
  Synthetic Polynucleotide
acggaaggaa

SEQ ID NO: 2162 - DNA, 10 bp, Artificial Sequence
  Synthetic Polynucleotide
tccgctccat

SEQ ID NO: 2163 - DNA, 10 bp, Artificial Sequence
  Synthetic Polynucleotide
atggagcaga

SEQ ID NO: 2164 - DNA, 10 bp, Artificial Sequence
  Synthetic Polynucleotide
tgttggtgtg

SEQ ID NO: 2165 - DNA, 10 bp, Artificial Sequence
  Synthetic Polynucleotide
tcgtctacga

SEQ ID NO: 2166 - DNA, 10 bp, Artificial Sequence
  Synthetic Polynucleotide
ccgtcctcct

SEQ ID NO: 2167 - DNA, 10 bp, Artificial Sequence
  Synthetic Polynucleotide
tgaacgaggt

SEQ ID NO: 2168 - DNA, 10 bp, Artificial Sequence
  Synthetic Polynucleotide
cgcagtcagt

SEQ ID NO: 2169 - DNA, 10 bp, Artificial Sequence
  Synthetic Polynucleotide
tatgcgatgt

SEQ ID NO: 2170 - DNA, 10 bp, Artificial Sequence
  Synthetic Polynucleotide
gacgatggta

SEQ ID NO: 2171 - DNA, 10 bp, Artificial Sequence
  Synthetic Polynucleotide
ttcgggatgt

SEQ ID NO: 2172 - DNA, 10 bp, Artificial Sequence
  Synthetic Polynucleotide
aggttggaca

SEQ ID NO: 2173 - DNA, 10 bp, Artificial Sequence
  Synthetic Polynucleotide
gcaagagcta

SEQ ID NO: 2174 - DNA, 10 bp, Artificial Sequence
  Synthetic Polynucleotide
cgaatgcagc

SEQ ID NO: 2175 - DNA, 10 bp, Artificial Sequence
  Synthetic Polynucleotide
ccgggctgat

SEQ ID NO: 2176 - DNA, 10 bp, Artificial Sequence
  Synthetic Polynucleotide
tgcgaagttg

SEQ ID NO: 2177 - DNA, 10 bp, Artificial Sequence
  Synthetic Polynucleotide
acgattgctg

SEQ ID NO: 2178 - DNA, 10 bp, Artificial Sequence
  Synthetic Polynucleotide
gacctgccaa

SEQ ID NO: 2179 - DNA, 10 bp, Artificial Sequence
  Synthetic Polynucleotide
tgttcatggc

SEQ ID NO: 2180 - DNA, 10 bp, Artificial Sequence
  Synthetic Polynucleotide
ccctcctgcc

SEQ ID NO: 2181 - DNA, 10 bp, Artificial Sequence
  Synthetic Polynucleotide
tcccaacgcg

SEQ ID NO: 2182 - DNA, 10 bp, Artificial Sequence
  Synthetic Polynucleotide
agccacacgc

SEQ ID NO: 2183 - DNA, 10 bp, Artificial Sequence
  Synthetic Polynucleotide
cggaagcggc

SEQ ID NO: 2184 - DNA, 10 bp, Artificial Sequence
  Synthetic Polynucleotide
gaccactgcc

SEQ ID NO: 2185 - DNA, 10 bp, Artificial Sequence
  Synthetic Polynucleotide
gggtcgttcg

SEQ ID NO: 2186 - DNA, 10 bp, Artificial Sequence
  Synthetic Polynucleotide
cttgccacca

SEQ ID NO: 2187 - DNA, 10 bp, Artificial Sequence
  Synthetic Polynucleotide
acagttgctg

SEQ ID NO: 2188 - DNA, 10 bp, Artificial Sequence
  Synthetic Polynucleotide
agccacatct

SEQ ID NO: 2189 - DNA, 10 bp, Artificial Sequence
  Synthetic Polynucleotide
taagacgggt

SEQ ID NO: 2190 - DNA, 10 bp, Artificial Sequence
  Synthetic Polynucleotide
ggtaagcacg

SEQ ID NO: 2191 - DNA, 10 bp, Artificial Sequence
  Synthetic Polynucleotide
cgtgatgtcg

SEQ ID NO: 2192 - DNA, 10 bp, Artificial Sequence
  Synthetic Polynucleotide
tccacaggga

SEQ ID NO: 2193 - DNA, 10 bp, Artificial Sequence
  Synthetic Polynucleotide
tagtgtcgct

SEQ ID NO: 2194 - DNA, 10 bp, Artificial Sequence
  Synthetic Polynucleotide
tgattcgacg

SEQ ID NO: 2195 - DNA, 10 bp, Artificial Sequence
  Synthetic Polynucleotide
ccctgcgtgg

SEQ ID NO: 2196 - DNA, 10 bp, Artificial Sequence
  Synthetic Polynucleotide
gcgataagcg

SEQ ID NO: 2197 - DNA, 10 bp, Artificial Sequence
  Synthetic Polynucleotide
tgatggacgc

SEQ ID NO: 2198 - DNA, 10 bp, Artificial Sequence
  Synthetic Polynucleotide
gcgtataccc

SEQ ID NO: 2199 - DNA, 10 bp, Artificial Sequence
  Synthetic Polynucleotide
tcatggcaga

SEQ ID NO: 2200 - DNA, 10 bp, Artificial Sequence
  Synthetic Polynucleotide
ctccctcacg

SEQ ID NO: 2201 - DNA, 10 bp, Artificial Sequence
  Synthetic Polynucleotide
tggaggaaga

SEQ ID NO: 2202 - DNA, 10 bp, Artificial Sequence
  Synthetic Polynucleotide
cacattcgcc

SEQ ID NO: 2203 - DNA, 10 bp, Artificial Sequence
  Synthetic Polynucleotide
cgaaacgtgc

SEQ ID NO: 2204 - DNA, 10 bp, Artificial Sequence
  Synthetic Polynucleotide
gtgcggttgg

SEQ ID NO: 2205 - DNA, 10 bp, Artificial Sequence
  Synthetic Polynucleotide
cgcaagaggt

SEQ ID NO: 2206 - DNA, 10 bp, Artificial Sequence
  Synthetic Polynucleotide
tctcccactc

SEQ ID NO: 2207 - DNA, 10 bp, Artificial Sequence
  Synthetic Polynucleotide
ggatggtggc

SEQ ID NO: 2208 - DNA, 10 bp, Artificial Sequence
  Synthetic Polynucleotide
gctgtgctga

SEQ ID NO: 2209 - DNA, 10 bp, Artificial Sequence
  Synthetic Polynucleotide
tggaggtgtg

SEQ ID NO: 2210 - DNA, 10 bp, Artificial Sequence
  Synthetic Polynucleotide
gaagttggca

SEQ ID NO: 2211 - DNA, 10 bp, Artificial Sequence
  Synthetic Polynucleotide
tgaagcgtgg

SEQ ID NO: 2212 - DNA, 10 bp, Artificial Sequence
  Synthetic Polynucleotide
tcatgcccat

SEQ ID NO: 2213 - DNA, 10 bp, Artificial Sequence
  Synthetic Polynucleotide
taagcggtga

SEQ ID NO: 2214 - DNA, 10 bp, Artificial Sequence
  Synthetic Polynucleotide
gcacgttcag

SEQ ID NO: 2215 - DNA, 10 bp, Artificial Sequence
  Synthetic Polynucleotide
ctgttgctga

SEQ ID NO: 2216 - DNA, 10 bp, Artificial Sequence
  Synthetic Polynucleotide
aacgcctctt

SEQ ID NO: 2217 - DNA, 10 bp, Artificial Sequence
  Synthetic Polynucleotide
tgcatgacag

SEQ ID NO: 2218 - DNA, 10 bp, Artificial Sequence
  Synthetic Polynucleotide
ggtctcaagc

SEQ ID NO: 2219 - DNA, 10 bp, Artificial Sequence
  Synthetic Polynucleotide
ctcaacgcct

SEQ ID NO: 2220 - DNA, 10 bp, Artificial Sequence
  Synthetic Polynucleotide
tcaccgcctc

SEQ ID NO: 2221 - DNA, 10 bp, Artificial Sequence
  Synthetic Polynucleotide
agcgatttgg

SEQ ID NO: 2222 - DNA, 10 bp, Artificial Sequence
  Synthetic Polynucleotide
tgcatagcgt

SEQ ID NO: 2223 - DNA, 10 bp, Artificial Sequence
  Synthetic Polynucleotide
gtgggttgga

SEQ ID NO: 2224 - DNA, 10 bp, Artificial Sequence
  Synthetic Polynucleotide
acgagtcctc

SEQ ID NO: 2225 - DNA, 10 bp, Artificial Sequence
  Synthetic Polynucleotide
tggaggacag

SEQ ID NO: 2226 - DNA, 10 bp, Artificial Sequence
  Synthetic Polynucleotide
cgctaactga

SEQ ID NO: 2227 - DNA, 10 bp, Artificial Sequence
  Synthetic Polynucleotide
ggtgttagcc

SEQ ID NO: 2228 - DNA, 10 bp, Artificial Sequence
  Synthetic Polynucleotide
acggttggag

SEQ ID NO: 2229 - DNA, 10 bp, Artificial Sequence
  Synthetic Polynucleotide
cgttcggctg

SEQ ID NO: 2230 - DNA, 10 bp, Artificial Sequence
  Synthetic Polynucleotide
ggtgtcagtg

SEQ ID NO: 2231 - DNA, 10 bp, Artificial Sequence
  Synthetic Polynucleotide
ttcgtgatgc

SEQ ID NO: 2232 - DNA, 10 bp, Artificial Sequence
  Synthetic Polynucleotide
attgccaccg

SEQ ID NO: 2233 - DNA, 10 bp, Artificial Sequence
  Synthetic Polynucleotide
tgctgaagga

SEQ ID NO: 2234 - DNA, 10 bp, Artificial Sequence
  Synthetic Polynucleotide
acgtcggaaa

SEQ ID NO: 2235 - DNA, 10 bp, Artificial Sequence
  Synthetic Polynucleotide
tcaacgctac

SEQ ID NO: 2236 - DNA, 10 bp, Artificial Sequence
  Synthetic Polynucleotide
acgtcttgca

SEQ ID NO: 2237 - DNA, 10 bp, Artificial Sequence
  Synthetic Polynucleotide
cagtccgagt

SEQ ID NO: 2238 - DNA, 10 bp, Artificial Sequence
  Synthetic Polynucleotide
tcctggggaa

SEQ ID NO: 2239 - DNA, 10 bp, Artificial Sequence
  Synthetic Polynucleotide
tcgatgaggc

SEQ ID NO: 2240 - DNA, 10 bp, Artificial Sequence
  Synthetic Polynucleotide
cggtccagaa

SEQ ID NO: 2241 - DNA, 10 bp, Artificial Sequence
  Synthetic Polynucleotide
tgtttgggct

SEQ ID NO: 2242 - DNA, 10 bp, Artificial Sequence
  Synthetic Polynucleotide
tcctcctgta

SEQ ID NO: 2243 - DNA, 10 bp, Artificial Sequence
  Synthetic Polynucleotide
gtttggtgcg

SEQ ID NO: 2244 - DNA, 10 bp, Artificial Sequence
  Synthetic Polynucleotide
acaggcatca

SEQ ID NO: 2245 - DNA, 10 bp, Artificial Sequence
  Synthetic Polynucleotide
atggagctga

SEQ ID NO: 2246 - DNA, 10 bp, Artificial Sequence
  Synthetic Polynucleotide
tgccgtaagc

SEQ ID NO: 2247 - DNA, 10 bp, Artificial Sequence
  Synthetic Polynucleotide
tcgaggatga

SEQ ID NO: 2248 - DNA, 10 bp, Artificial Sequence
  Synthetic Polynucleotide
cgtcacgagt

SEQ ID NO: 2249 - DNA, 10 bp, Artificial Sequence
  Synthetic Polynucleotide
tggtgactca

SEQ ID NO: 2250 - DNA, 10 bp, Artificial Sequence
  Synthetic Polynucleotide
ctacgcagcc

SEQ ID NO: 2251 - DNA, 10 bp, Artificial Sequence
  Synthetic Polynucleotide
cccactttgg

SEQ ID NO: 2252 - DNA, 10 bp, Artificial Sequence
  Synthetic Polynucleotide
tgatcctgca

SEQ ID NO: 2253 - DNA, 10 bp, Artificial Sequence
  Synthetic Polynucleotide
ctttggtcga

SEQ ID NO: 2254 - DNA, 10 bp, Artificial Sequence
  Synthetic Polynucleotide
tgatttccgc

SEQ ID NO: 2255 - DNA, 10 bp, Artificial Sequence
  Synthetic Polynucleotide
gaacgatggg

SEQ ID NO: 2256 - DNA, 10 bp, Artificial Sequence
  Synthetic Polynucleotide
cgtccattcc

SEQ ID NO: 2257 - DNA, 10 bp, Artificial Sequence
  Synthetic Polynucleotide
tgaaggtgga

SEQ ID NO: 2258 - DNA, 10 bp, Artificial Sequence
  Synthetic Polynucleotide
gtgaaaggcg

SEQ ID NO: 2259 - DNA, 10 bp, Artificial Sequence
  Synthetic Polynucleotide
atgagggcat

SEQ ID NO: 2260 - DNA, 10 bp, Artificial Sequence
  Synthetic Polynucleotide
gtgcgaggaa

SEQ ID NO: 2261 - DNA, 10 bp, Artificial Sequence
  Synthetic Polynucleotide
gcattgacgg

SEQ ID NO: 2262 - DNA, 10 bp, Artificial Sequence
  Synthetic Polynucleotide
agagcgtaca

SEQ ID NO: 2263 - DNA, 10 bp, Artificial Sequence
  Synthetic Polynucleotide
acagcgagaa

SEQ ID NO: 2264 - DNA, 10 bp, Artificial Sequence
  Synthetic Polynucleotide
ggattggggc

SEQ ID NO: 2265 - DNA, 10 bp, Artificial Sequence
  Synthetic Polynucleotide
gctgttgaca

SEQ ID NO: 2266 - DNA, 10 bp, Artificial Sequence
  Synthetic Polynucleotide
tccattctgc

SEQ ID NO: 2267 - DNA, 10 bp, Artificial Sequence
  Synthetic Polynucleotide
ggaccaggta

SEQ ID NO: 2268 - DNA, 10 bp, Artificial Sequence
  Synthetic Polynucleotide
actgtggccc

SEQ ID NO: 2269 - DNA, 10 bp, Artificial Sequence
  Synthetic Polynucleotide
ctcgagcact

SEQ ID NO: 2270 - DNA, 10 bp, Artificial Sequence
  Synthetic Polynucleotide
agtgccaaca

SEQ ID NO: 2271 - DNA, 10 bp, Artificial Sequence
  Synthetic Polynucleotide
agttcgggaa

SEQ ID NO: 2272 - DNA, 10 bp, Artificial Sequence
  Synthetic Polynucleotide
gcctgaagcg

SEQ ID NO: 2273 - DNA, 10 bp, Artificial Sequence
  Synthetic Polynucleotide
tgcatttcgg

SEQ ID NO: 2274 - DNA, 10 bp, Artificial Sequence
  Synthetic Polynucleotide
tgtggtgagt

SEQ ID NO: 2275 - DNA, 10 bp, Artificial Sequence
  Synthetic Polynucleotide
tatggaaggc

SEQ ID NO: 2276 - DNA, 10 bp, Artificial Sequence
  Synthetic Polynucleotide
tcaccttgca

SEQ ID NO: 2277 - DNA, 10 bp, Artificial Sequence
  Synthetic Polynucleotide
agacccagct

SEQ ID NO: 2278 - DNA, 10 bp, Artificial Sequence
  Synthetic Polynucleotide
ctctgtgctc

SEQ ID NO: 2279 - DNA, 10 bp, Artificial Sequence
  Synthetic Polynucleotide
ttgggagtga

SEQ ID NO: 2280 - DNA, 10 bp, Artificial Sequence
  Synthetic Polynucleotide
caacttcgcc

SEQ ID NO: 2281 - DNA, 10 bp, Artificial Sequence
  Synthetic Polynucleotide
cgtccggctt

SEQ ID NO: 2282 - DNA, 10 bp, Artificial Sequence
  Synthetic Polynucleotide
ccaagatgcg

SEQ ID NO: 2283 - DNA, 10 bp, Artificial Sequence
  Synthetic Polynucleotide
gttggaacgt

SEQ ID NO: 2284 - DNA, 10 bp, Artificial Sequence
  Synthetic Polynucleotide
cccttacccc

SEQ ID NO: 2285 - DNA, 10 bp, Artificial Sequence
  Synthetic Polynucleotide
gcggaatggg

SEQ ID NO: 2286 - DNA, 10 bp, Artificial Sequence
  Synthetic Polynucleotide
tcttgctcca

SEQ ID NO: 2287 - DNA, 10 bp, Artificial Sequence
  Synthetic Polynucleotide
gagtttgcca

SEQ ID NO: 2288 - DNA, 10 bp, Artificial Sequence
  Synthetic Polynucleotide
tctttgctcc

SEQ ID NO: 2289 - DNA, 10 bp, Artificial Sequence
  Synthetic Polynucleotide
acgatgcgag

SEQ ID NO: 2290 - DNA, 10 bp, Artificial Sequence
  Synthetic Polynucleotide
gcggtctgag

SEQ ID NO: 2291 - DNA, 10 bp, Artificial Sequence
  Synthetic Polynucleotide
gtgtcgaacc

SEQ ID NO: 2292 - DNA, 10 bp, Artificial Sequence
  Synthetic Polynucleotide
tgaagctcct

SEQ ID NO: 2293 - DNA, 10 bp, Artificial Sequence
  Synthetic Polynucleotide
gaagcgtggt

SEQ ID NO: 2294 - DNA, 10 bp, Artificial Sequence
  Synthetic Polynucleotide
tcggaacacc

SEQ ID NO: 2295 - DNA, 10 bp, Artificial Sequence
  Synthetic Polynucleotide
aatcgtcgtg

SEQ ID NO: 2296 - DNA, 10 bp, Artificial Sequence
  Synthetic Polynucleotide
tagcaacgtt

SEQ ID NO: 2297 - DNA, 10 bp, Artificial Sequence
  Synthetic Polynucleotide
cttccactcg

SEQ ID NO: 2298 - DNA, 10 bp, Artificial Sequence
  Synthetic Polynucleotide
gtcttcgcca

SEQ ID NO: 2299 - DNA, 10 bp, Artificial Sequence
  Synthetic Polynucleotide
agcgaaggtt

SEQ ID NO: 2300 - DNA, 10 bp, Artificial Sequence
  Synthetic Polynucleotide
gcgttcagaa

SEQ ID NO: 2301 - DNA, 10 bp, Artificial Sequence
  Synthetic Polynucleotide
cgcttgacgc

SEQ ID NO: 2302 - DNA, 10 bp, Artificial Sequence
  Synthetic Polynucleotide
acactgcctg

SEQ ID NO: 2303 - DNA, 10 bp, Artificial Sequence
  Synthetic Polynucleotide
cgatccgtct

SEQ ID NO: 2304 - DNA, 10 bp, Artificial Sequence
  Synthetic Polynucleotide
gagttggccc

SEQ ID NO: 2305 - DNA, 10 bp, Artificial Sequence
  Synthetic Polynucleotide
tcgtggatct

SEQ ID NO: 2306 - DNA, 10 bp, Artificial Sequence
  Synthetic Polynucleotide
cacacaggac

SEQ ID NO: 2307 - DNA, 10 bp, Artificial Sequence
  Synthetic Polynucleotide
tgaagccagg

SEQ ID NO: 2308 - DNA, 10 bp, Artificial Sequence
  Synthetic Polynucleotide
aggcacaaga

SEQ ID NO: 2309 - DNA, 10 bp, Artificial Sequence
  Synthetic Polynucleotide
agagctgacg

SEQ ID NO: 2310 - DNA, 10 bp, Artificial Sequence
  Synthetic Polynucleotide
tcgcacccaa

SEQ ID NO: 2311 - DNA, 10 bp, Artificial Sequence
  Synthetic Polynucleotide
accagatgca

SEQ ID NO: 2312 - DNA, 10 bp, Artificial Sequence
  Synthetic Polynucleotide
tagcgatggc

SEQ ID NO: 2313 - DNA, 10 bp, Artificial Sequence
  Synthetic Polynucleotide
agacgccaat

SEQ ID NO: 2314 - DNA, 10 bp, Artificial Sequence
  Synthetic Polynucleotide
taagcactga

SEQ ID NO: 2315 - DNA, 10 bp, Artificial Sequence
  Synthetic Polynucleotide
acggtgatgc

SEQ ID NO: 2316 - DNA, 10 bp, Artificial Sequence
  Synthetic Polynucleotide
tgggaacgtt

SEQ ID NO: 2317 - DNA, 10 bp, Artificial Sequence
  Synthetic Polynucleotide
tgggcatccg

SEQ ID NO: 2318 - DNA, 10 bp, Artificial Sequence
  Synthetic Polynucleotide
cggttggagt

SEQ ID NO: 2319 - DNA, 10 bp, Artificial Sequence
  Synthetic Polynucleotide
cagaacgcat

SEQ ID NO: 2320 - DNA, 10 bp, Artificial Sequence
  Synthetic Polynucleotide
agctgaccaa

SEQ ID NO: 2321 - DNA, 10 bp, Artificial Sequence
  Synthetic Polynucleotide
tctagcagca

SEQ ID NO: 2322 - DNA, 10 bp, Artificial Sequence
  Synthetic Polynucleotide
tcaacagcca

SEQ ID NO: 2323 - DNA, 10 bp, Artificial Sequence
  Synthetic Polynucleotide
acgcctgata

SEQ ID NO: 2324 - DNA, 10 bp, Artificial Sequence
  Synthetic Polynucleotide
tgccacgctc

SEQ ID NO: 2325 - DNA, 10 bp, Artificial Sequence
  Synthetic Polynucleotide
tgctacgcaa

SEQ ID NO: 2326 - DNA, 10 bp, Artificial Sequence
  Synthetic Polynucleotide
gctgtgaaca

SEQ ID NO: 2327 - DNA, 10 bp, Artificial Sequence
  Synthetic Polynucleotide
tacaccccaa

SEQ ID NO: 2328 - DNA, 10 bp, Artificial Sequence
  Synthetic Polynucleotide
cggacggtac

SEQ ID NO: 2329 - DNA, 10 bp, Artificial Sequence
  Synthetic Polynucleotide
tggaaacgtg

SEQ ID NO: 2330 - DNA, 10 bp, Artificial Sequence
  Synthetic Polynucleotide
gccatacgta

SEQ ID NO: 2331 - DNA, 10 bp, Artificial Sequence
  Synthetic Polynucleotide
tatggacgtg

SEQ ID NO: 2332 - DNA, 10 bp, Artificial Sequence
  Synthetic Polynucleotide
tgagcattgc

SEQ ID NO: 2333 - DNA, 10 bp, Artificial Sequence
  Synthetic Polynucleotide
ccggctcttg

SEQ ID NO: 2334 - DNA, 10 bp, Artificial Sequence
  Synthetic Polynucleotide
tgcgtcctca

SEQ ID NO: 2335 - DNA, 10 bp, Artificial Sequence
  Synthetic Polynucleotide
ttggacgcac

SEQ ID NO: 2336 - DNA, 10 bp, Artificial Sequence
  Synthetic Polynucleotide
acgtgtcatg

SEQ ID NO: 2337 - DNA, 10 bp, Artificial Sequence
  Synthetic Polynucleotide
agtttgccca

SEQ ID NO: 2338 - DNA, 10 bp, Artificial Sequence
  Synthetic Polynucleotide
cacttgctga

SEQ ID NO: 2339 - DNA, 10 bp, Artificial Sequence
  Synthetic Polynucleotide
ttgaatgcgc

SEQ ID NO: 2340 - DNA, 10 bp, Artificial Sequence
  Synthetic Polynucleotide
tcacatccca

SEQ ID NO: 2341 - DNA, 10 bp, Artificial Sequence
  Synthetic Polynucleotide
atcgctccgg

SEQ ID NO: 2342 - DNA, 10 bp, Artificial Sequence
  Synthetic Polynucleotide
tcgcacccat

SEQ ID NO: 2343 - DNA, 10 bp, Artificial Sequence
  Synthetic Polynucleotide
cgatccgagg

SEQ ID NO: 2344 - DNA, 10 bp, Artificial Sequence
  Synthetic Polynucleotide
cacacctgcc

SEQ ID NO: 2345 - DNA, 10 bp, Artificial Sequence
  Synthetic Polynucleotide
gaccaactgg

SEQ ID NO: 2346 - DNA, 10 bp, Artificial Sequence
  Synthetic Polynucleotide
gctcatcccc

SEQ ID NO: 2347 - DNA, 10 bp, Artificial Sequence
  Synthetic Polynucleotide
tcgctcaaag

SEQ ID NO: 2348 - DNA, 10 bp, Artificial Sequence
  Synthetic Polynucleotide
gcaccttgag

SEQ ID NO: 2349 - DNA, 10 bp, Artificial Sequence
  Synthetic Polynucleotide
gcggcattga

SEQ ID NO: 2350 - DNA, 10 bp, Artificial Sequence
  Synthetic Polynucleotide
aagccaccag

SEQ ID NO: 2351 - DNA, 10 bp, Artificial Sequence
  Synthetic Polynucleotide
aatcgaccca

SEQ ID NO: 2352 - DNA, 10 bp, Artificial Sequence
  Synthetic Polynucleotide
tgcaccattg

SEQ ID NO: 2353 - DNA, 10 bp, Artificial Sequence
  Synthetic Polynucleotide
tgatcccgag

SEQ ID NO: 2354 - DNA, 10 bp, Artificial Sequence
  Synthetic Polynucleotide
cacttgtgct

SEQ ID NO: 2355 - DNA, 10 bp, Artificial Sequence
  Synthetic Polynucleotide
gcaccagtcg

SEQ ID NO: 2356 - DNA, 10 bp, Artificial Sequence
  Synthetic Polynucleotide
taagggcaga

SEQ ID NO: 2357 - DNA, 10 bp, Artificial Sequence
  Synthetic Polynucleotide
ttgtcatggc

SEQ ID NO: 2358 - DNA, 10 bp, Artificial Sequence
  Synthetic Polynucleotide
gaacgatgcc

SEQ ID NO: 2359 - DNA, 10 bp, Artificial Sequence
  Synthetic Polynucleotide
tgacgcattg

SEQ ID NO: 2360 - DNA, 10 bp, Artificial Sequence
  Synthetic Polynucleotide
gcatcaacga

SEQ ID NO: 2361 - DNA, 10 bp, Artificial Sequence
  Synthetic Polynucleotide
tggcgaatga

SEQ ID NO: 2362 - DNA, 10 bp, Artificial Sequence
  Synthetic Polynucleotide
gagacgcagt

SEQ ID NO: 2363 - DNA, 10 bp, Artificial Sequence
  Synthetic Polynucleotide
gcatatcggc

SEQ ID NO: 2364 - DNA, 10 bp, Artificial Sequence
  Synthetic Polynucleotide
tcaacaacga

SEQ ID NO: 2365 - DNA, 10 bp, Artificial Sequence
  Synthetic Polynucleotide
tgttcccgtt

SEQ ID NO: 2366 - DNA, 10 bp, Artificial Sequence
  Synthetic Polynucleotide
tggatcgtca

SEQ ID NO: 2367 - DNA, 10 bp, Artificial Sequence
  Synthetic Polynucleotide
gcgaaagaga

SEQ ID NO: 2368 - DNA, 10 bp, Artificial Sequence
  Synthetic Polynucleotide
caatcgtgca

SEQ ID NO: 2369 - DNA, 10 bp, Artificial Sequence
  Synthetic Polynucleotide
agaccaccac

SEQ ID NO: 2370 - DNA, 10 bp, Artificial Sequence
  Synthetic Polynucleotide
cggatatcgc

SEQ ID NO: 2371 - DNA, 10 bp, Artificial Sequence
  Synthetic Polynucleotide
agaggcttca

SEQ ID NO: 2372 - DNA, 10 bp, Artificial Sequence
  Synthetic Polynucleotide
cattccgggt

SEQ ID NO: 2373 - DNA, 10 bp, Artificial Sequence
  Synthetic Polynucleotide
tgaacgagca

SEQ ID NO: 2374 - DNA, 10 bp, Artificial Sequence
  Synthetic Polynucleotide
tgctgctgaa

SEQ ID NO: 2375 - DNA, 10 bp, Artificial Sequence
  Synthetic Polynucleotide
gttgacggtg

SEQ ID NO: 2376 - DNA, 10 bp, Artificial Sequence
  Synthetic Polynucleotide
tcacgtttca

SEQ ID NO: 2377 - DNA, 10 bp, Artificial Sequence
  Synthetic Polynucleotide
tggcggtaaa

SEQ ID NO: 2378 - DNA, 10 bp, Artificial Sequence
  Synthetic Polynucleotide
ccctccgata

SEQ ID NO: 2379 - DNA, 10 bp, Artificial Sequence
  Synthetic Polynucleotide
tttcgttgca

SEQ ID NO: 2380 - DNA, 10 bp, Artificial Sequence
  Synthetic Polynucleotide
tgctctggac

SEQ ID NO: 2381 - DNA, 10 bp, Artificial Sequence
  Synthetic Polynucleotide
aatgttgccg

SEQ ID NO: 2382 - DNA, 10 bp, Artificial Sequence
  Synthetic Polynucleotide
gctcttgcgt

SEQ ID NO: 2383 - DNA, 10 bp, Artificial Sequence
  Synthetic Polynucleotide
ctcctccgtt

SEQ ID NO: 2384 - DNA, 10 bp, Artificial Sequence
  Synthetic Polynucleotide
cacgttgtca

SEQ ID NO: 2385 - DNA, 10 bp, Artificial Sequence
  Synthetic Polynucleotide
acgagtttgc

SEQ ID NO: 2386 - DNA, 10 bp, Artificial Sequence
  Synthetic Polynucleotide
cacgagtcac

SEQ ID NO: 2387 - DNA, 10 bp, Artificial Sequence
  Synthetic Polynucleotide
caaaggctga

SEQ ID NO: 2388 - DNA, 10 bp, Artificial Sequence
  Synthetic Polynucleotide
tccaaagcag

SEQ ID NO: 2389 - DNA, 10 bp, Artificial Sequence
  Synthetic Polynucleotide
gctagcgaga

SEQ ID NO: 2390 - DNA, 10 bp, Artificial Sequence
  Synthetic Polynucleotide
gagcggttgg

SEQ ID NO: 2391 - DNA, 10 bp, Artificial Sequence
  Synthetic Polynucleotide
ggaggtgcgt

SEQ ID NO: 2392 - DNA, 10 bp, Artificial Sequence
  Synthetic Polynucleotide
tggcgattct

SEQ ID NO: 2393 - DNA, 10 bp, Artificial Sequence
  Synthetic Polynucleotide
ggtccgttac

SEQ ID NO: 2394 - DNA, 10 bp, Artificial Sequence
  Synthetic Polynucleotide
ggcggacatc

SEQ ID NO: 2395 - DNA, 10 bp, Artificial Sequence
  Synthetic Polynucleotide
tgttggctta

SEQ ID NO: 2396 - DNA, 10 bp, Artificial Sequence
  Synthetic Polynucleotide
agccgaaagg

SEQ ID NO: 2397 - DNA, 10 bp, Artificial Sequence
  Synthetic Polynucleotide
agtggagtcc

SEQ ID NO: 2398 - DNA, 10 bp, Artificial Sequence
  Synthetic Polynucleotide
cagggaacac

SEQ ID NO: 2399 - DNA, 10 bp, Artificial Sequence
  Synthetic Polynucleotide
gttgatgcca

SEQ ID NO: 2400 - DNA, 10 bp, Artificial Sequence
  Synthetic Polynucleotide
tcccactcat

SEQ ID NO: 2401 - DNA, 10 bp, Artificial Sequence
  Synthetic Polynucleotide
acccttcgtc

SEQ ID NO: 2402 - DNA, 10 bp, Artificial Sequence
  Synthetic Polynucleotide
tcattccgtc

SEQ ID NO: 2403 - DNA, 10 bp, Artificial Sequence
  Synthetic Polynucleotide
agaacgatgc

SEQ ID NO: 2404 - DNA, 10 bp, Artificial Sequence
  Synthetic Polynucleotide
gttgcccatc

SEQ ID NO: 2405 - DNA, 10 bp, Artificial Sequence
  Synthetic Polynucleotide
cggagatgga

SEQ ID NO: 2406 - DNA, 10 bp, Artificial Sequence
  Synthetic Polynucleotide
acaaccgaac

SEQ ID NO: 2407 - DNA, 10 bp, Artificial Sequence
  Synthetic Polynucleotide
ccgtaccgta

SEQ ID NO: 2408 - DNA, 10 bp, Artificial Sequence
  Synthetic Polynucleotide
tggctcctga

SEQ ID NO: 2409 - DNA, 10 bp, Artificial Sequence
  Synthetic Polynucleotide
gatgcaggta

SEQ ID NO: 2410 - DNA, 10 bp, Artificial Sequence
  Synthetic Polynucleotide
tgcgtaccct

SEQ ID NO: 2411 - DNA, 10 bp, Artificial Sequence
  Synthetic Polynucleotide
gcttctcgtg

SEQ ID NO: 2412 - DNA, 10 bp, Artificial Sequence
  Synthetic Polynucleotide
agacacccag

SEQ ID NO: 2413 - DNA, 10 bp, Artificial Sequence
  Synthetic Polynucleotide
aagcagaagc

SEQ ID NO: 2414 - DNA, 10 bp, Artificial Sequence
  Synthetic Polynucleotide
tcttcctgca

SEQ ID NO: 2415 - DNA, 10 bp, Artificial Sequence
  Synthetic Polynucleotide
gcggaacgtt

SEQ ID NO: 2416 - DNA, 10 bp, Artificial Sequence
  Synthetic Polynucleotide
tggatagcca

SEQ ID NO: 2417 - DNA, 10 bp, Artificial Sequence
  Synthetic Polynucleotide
ggatatgcgc

SEQ ID NO: 2418 - DNA, 10 bp, Artificial Sequence
  Synthetic Polynucleotide
taggcgtttt

SEQ ID NO: 2419 - DNA, 10 bp, Artificial Sequence
  Synthetic Polynucleotide
tacaggcaca

SEQ ID NO: 2420 - DNA, 10 bp, Artificial Sequence
  Synthetic Polynucleotide
cctcactcca

SEQ ID NO: 2421 - DNA, 10 bp, Artificial Sequence
  Synthetic Polynucleotide
ggcaaccagc

SEQ ID NO: 2422 - DNA, 10 bp, Artificial Sequence
  Synthetic Polynucleotide
caactccacc

SEQ ID NO: 2423 - DNA, 10 bp, Artificial Sequence
  Synthetic Polynucleotide
gcatcatgct

SEQ ID NO: 2424 - DNA, 10 bp, Artificial Sequence
  Synthetic Polynucleotide
tccaccaaca

SEQ ID NO: 2425 - DNA, 10 bp, Artificial Sequence
  Synthetic Polynucleotide
tccgacttgt

SEQ ID NO: 2426 - DNA, 10 bp, Artificial Sequence
  Synthetic Polynucleotide
agccactctc

SEQ ID NO: 2427 - DNA, 10 bp, Artificial Sequence
  Synthetic Polynucleotide
atggggaacg

SEQ ID NO: 2428 - DNA, 10 bp, Artificial Sequence
  Synthetic Polynucleotide
tcgcttgagg

SEQ ID NO: 2429 - DNA, 10 bp, Artificial Sequence
  Synthetic Polynucleotide
atgaggagca

SEQ ID NO: 2430 - DNA, 10 bp, Artificial Sequence
  Synthetic Polynucleotide
tcctcttcca

SEQ ID NO: 2431 - DNA, 10 bp, Artificial Sequence
  Synthetic Polynucleotide
tctggaccaa

SEQ ID NO: 2432 - DNA, 10 bp, Artificial Sequence
  Synthetic Polynucleotide
agccatccat

SEQ ID NO: 2433 - DNA, 10 bp, Artificial Sequence
  Synthetic Polynucleotide
attgtggtgc

SEQ ID NO: 2434 - DNA, 10 bp, Artificial Sequence
  Synthetic Polynucleotide
acccatgcgt

SEQ ID NO: 2435 - DNA, 10 bp, Artificial Sequence
  Synthetic Polynucleotide
aaagatgcgg

SEQ ID NO: 2436 - DNA, 10 bp, Artificial Sequence
  Synthetic Polynucleotide
acaatgcgtt

SEQ ID NO: 2437 - DNA, 10 bp, Artificial Sequence
  Synthetic Polynucleotide
ctctgatgcc

SEQ ID NO: 2438 - DNA, 10 bp, Artificial Sequence
  Synthetic Polynucleotide
tcatgcccat

SEQ ID NO: 2439 - DNA, 10 bp, Artificial Sequence
  Synthetic Polynucleotide
tcacacggtc

SEQ ID NO: 2440 - DNA, 10 bp, Artificial Sequence
  Synthetic Polynucleotide
gtaagctccg

SEQ ID NO: 2441 - DNA, 10 bp, Artificial Sequence
  Synthetic Polynucleotide
acaggaaccg

SEQ ID NO: 2442 - DNA, 10 bp, Artificial Sequence
  Synthetic Polynucleotide
tgtttgcgtt

SEQ ID NO: 2443 - DNA, 10 bp, Artificial Sequence
  Synthetic Polynucleotide
taggcgatga

SEQ ID NO: 2444 - DNA, 10 bp, Artificial Sequence
  Synthetic Polynucleotide
tggcttctca

SEQ ID NO: 2445 - DNA, 10 bp, Artificial Sequence
  Synthetic Polynucleotide
ccgacctcaa

SEQ ID NO: 2446 - DNA, 10 bp, Artificial Sequence
  Synthetic Polynucleotide
ttgtggcgta

SEQ ID NO: 2447 - DNA, 10 bp, Artificial Sequence
  Synthetic Polynucleotide
caggtggtga

SEQ ID NO: 2448 - DNA, 10 bp, Artificial Sequence
  Synthetic Polynucleotide
cggttgtcta

SEQ ID NO: 2449 - DNA, 10 bp, Artificial Sequence
  Synthetic Polynucleotide
cggtggaagt

SEQ ID NO: 2450 - DNA, 10 bp, Artificial Sequence
  Synthetic Polynucleotide
actggacgtg

SEQ ID NO: 2451 - DNA, 10 bp, Artificial Sequence
  Synthetic Polynucleotide
tactgcaagc

SEQ ID NO: 2452 - DNA, 10 bp, Artificial Sequence
  Synthetic Polynucleotide
cgcttcgacg

SEQ ID NO: 2453 - DNA, 10 bp, Artificial Sequence
  Synthetic Polynucleotide
ctgtgcgatg

SEQ ID NO: 2454 - DNA, 10 bp, Artificial Sequence
  Synthetic Polynucleotide
caacatcgcc

SEQ ID NO: 2455 - DNA, 10 bp, Artificial Sequence
  Synthetic Polynucleotide
gatgcggaca

SEQ ID NO: 2456 - DNA, 10 bp, Artificial Sequence
  Synthetic Polynucleotide
caggagccag

SEQ ID NO: 2457 - DNA, 10 bp, Artificial Sequence
  Synthetic Polynucleotide
cttccgttcg

SEQ ID NO: 2458 - DNA, 10 bp, Artificial Sequence
  Synthetic Polynucleotide
cggcggagtc

SEQ ID NO: 2459 - DNA, 10 bp, Artificial Sequence
  Synthetic Polynucleotide
gccaccgagt

SEQ ID NO: 2460 - DNA, 10 bp, Artificial Sequence
  Synthetic Polynucleotide
ctggaatcgg

SEQ ID NO: 2461 - DNA, 10 bp, Artificial Sequence
  Synthetic Polynucleotide
ctgccctcaa

SEQ ID NO: 2462 - DNA, 10 bp, Artificial Sequence
  Synthetic Polynucleotide
caacctgctc

SEQ ID NO: 2463 - DNA, 10 bp, Artificial Sequence
  Synthetic Polynucleotide
atggtgctgg

SEQ ID NO: 2464 - DNA, 10 bp, Artificial Sequence
  Synthetic Polynucleotide
gcggtcagtt

SEQ ID NO: 2465 - DNA, 10 bp, Artificial Sequence
  Synthetic Polynucleotide
tgaacccgaa

SEQ ID NO: 2466 - DNA, 10 bp, Artificial Sequence
  Synthetic Polynucleotide
tcaggtccac

SEQ ID NO: 2467 - DNA, 10 bp, Artificial Sequence
  Synthetic Polynucleotide
tctgttgctg

SEQ ID NO: 2468 - DNA, 10 bp, Artificial Sequence
  Synthetic Polynucleotide
tttgcctgca

SEQ ID NO: 2469 - DNA, 10 bp, Artificial Sequence
  Synthetic Polynucleotide
atcggctgtt

SEQ ID NO: 2470 - DNA, 10 bp, Artificial Sequence
  Synthetic Polynucleotide
aacggcatta

SEQ ID NO: 2471 - DNA, 10 bp, Artificial Sequence
  Synthetic Polynucleotide
acaatgggga

SEQ ID NO: 2472 - DNA, 10 bp, Artificial Sequence
  Synthetic Polynucleotide
gtagcaaggc

SEQ ID NO: 2473 - DNA, 10 bp, Artificial Sequence
  Synthetic Polynucleotide
tcgcagtgtc

SEQ ID NO: 2474 - DNA, 10 bp, Artificial Sequence
  Synthetic Polynucleotide
gctacgaacc

SEQ ID NO: 2475 - DNA, 10 bp, Artificial Sequence
  Synthetic Polynucleotide
cattcgccaa

SEQ ID NO: 2476 - DNA, 10 bp, Artificial Sequence
  Synthetic Polynucleotide
tgccaacgct

SEQ ID NO: 2477 - DNA, 10 bp, Artificial Sequence
  Synthetic Polynucleotide
tcttcatgcg

SEQ ID NO: 2478 - DNA, 10 bp, Artificial Sequence
  Synthetic Polynucleotide
agccctcaat

SEQ ID NO: 2479 - DNA, 10 bp, Artificial Sequence
  Synthetic Polynucleotide
cagtgatgca

SEQ ID NO: 2480 - DNA, 10 bp, Artificial Sequence
  Synthetic Polynucleotide
agcccaagca

SEQ ID NO: 2481 - DNA, 10 bp, Artificial Sequence
  Synthetic Polynucleotide
agtgtcgcta

SEQ ID NO: 2482 - DNA, 10 bp, Artificial Sequence
  Synthetic Polynucleotide
accagcacgc

SEQ ID NO: 2483 - DNA, 10 bp, Artificial Sequence
  Synthetic Polynucleotide
cgctgacgag

SEQ ID NO: 2484 - DNA, 10 bp, Artificial Sequence
  Synthetic Polynucleotide
acgcttcctt

SEQ ID NO: 2485 - DNA, 10 bp, Artificial Sequence
  Synthetic Polynucleotide
gaccgaggtg

SEQ ID NO: 2486 - DNA, 10 bp, Artificial Sequence
  Synthetic Polynucleotide
acgctaacgc

SEQ ID NO: 2487 - DNA, 10 bp, Artificial Sequence
  Synthetic Polynucleotide
cggcaaactt

SEQ ID NO: 2488 - DNA, 10 bp, Artificial Sequence
  Synthetic Polynucleotide
tcgttcccat

SEQ ID NO: 2489 - DNA, 10 bp, Artificial Sequence
  Synthetic Polynucleotide
tggtgtgttg

SEQ ID NO: 2490 - DNA, 10 bp, Artificial Sequence
  Synthetic Polynucleotide
cttccggttc

SEQ ID NO: 2491 - DNA, 10 bp, Artificial Sequence
  Synthetic Polynucleotide
atcggcaaag

SEQ ID NO: 2492 - DNA, 10 bp, Artificial Sequence
  Synthetic Polynucleotide
ggcacccaag

SEQ ID NO: 2493 - DNA, 10 bp, Artificial Sequence
  Synthetic Polynucleotide
cccgcaaata

SEQ ID NO: 2494 - DNA, 10 bp, Artificial Sequence
  Synthetic Polynucleotide
tcctcgtgtg

SEQ ID NO: 2495 - DNA, 10 bp, Artificial Sequence
  Synthetic Polynucleotide
acgtcagcca

SEQ ID NO: 2496 - DNA, 10 bp, Artificial Sequence
  Synthetic Polynucleotide
acgctcgaag

SEQ ID NO: 2497 - DNA, 10 bp, Artificial Sequence
  Synthetic Polynucleotide
agggatacgc

SEQ ID NO: 2498 - DNA, 10 bp, Artificial Sequence
  Synthetic Polynucleotide
cgcaaccctt

SEQ ID NO: 2499 - DNA, 10 bp, Artificial Sequence
  Synthetic Polynucleotide
aacgctgagt

SEQ ID NO: 2500 - DNA, 10 bp, Artificial Sequence
  Synthetic Polynucleotide
tgccacccat

SEQ ID NO: 2501 - DNA, 10 bp, Artificial Sequence
  Synthetic Polynucleotide
tattccacgc

SEQ ID NO: 2502 - DNA, 10 bp, Artificial Sequence
  Synthetic Polynucleotide
tcttcaccct

SEQ ID NO: 2503 - DNA, 10 bp, Artificial Sequence
  Synthetic Polynucleotide
gcttccgcac

SEQ ID NO: 2504 - DNA, 10 bp, Artificial Sequence
  Synthetic Polynucleotide
tcctgcctgt

SEQ ID NO: 2505 - DNA, 10 bp, Artificial Sequence
  Synthetic Polynucleotide
tgaggactcc

SEQ ID NO: 2506 - DNA, 10 bp, Artificial Sequence
  Synthetic Polynucleotide
cgcaaccaag

SEQ ID NO: 2507 - DNA, 10 bp, Artificial Sequence
  Synthetic Polynucleotide
gcacaaggac

SEQ ID NO: 2508 - DNA, 10 bp, Artificial Sequence
  Synthetic Polynucleotide
agccatacgt

SEQ ID NO: 2509 - DNA, 10 bp, Artificial Sequence
  Synthetic Polynucleotide
acccaatcca

SEQ ID NO: 2510 - DNA, 10 bp, Artificial Sequence
  Synthetic Polynucleotide
tcgtccaagt

SEQ ID NO: 2511 - DNA, 10 bp, Artificial Sequence
  Synthetic Polynucleotide
agttggtgca

SEQ ID NO: 2512 - DNA, 10 bp, Artificial Sequence
  Synthetic Polynucleotide
cttccgccgc

SEQ ID NO: 2513 - DNA, 10 bp, Artificial Sequence
  Synthetic Polynucleotide
aagaggcgac

SEQ ID NO: 2514 - DNA, 10 bp, Artificial Sequence
  Synthetic Polynucleotide
tgtttcggta

SEQ ID NO: 2515 - DNA, 10 bp, Artificial Sequence
  Synthetic Polynucleotide
tccgcaaatg

SEQ ID NO: 2516 - DNA, 10 bp, Artificial Sequence
  Synthetic Polynucleotide
atcctcgggg

SEQ ID NO: 2517 - DNA, 10 bp, Artificial Sequence
  Synthetic Polynucleotide
ctcactgcgt

SEQ ID NO: 2518 - DNA, 10 bp, Artificial Sequence
  Synthetic Polynucleotide
atcaccgcca

SEQ ID NO: 2519 - DNA, 10 bp, Artificial Sequence
  Synthetic Polynucleotide
tcctccgtta

SEQ ID NO: 2520 - DNA, 10 bp, Artificial Sequence
  Synthetic Polynucleotide
tcgcaaccat

SEQ ID NO: 2521 - DNA, 10 bp, Artificial Sequence
  Synthetic Polynucleotide
ctgacagcca

SEQ ID NO: 2522 - DNA, 10 bp, Artificial Sequence
  Synthetic Polynucleotide
atcgccaatg

SEQ ID NO: 2523 - DNA, 10 bp, Artificial Sequence
  Synthetic Polynucleotide
cctgagtggt

SEQ ID NO: 2524 - DNA, 10 bp, Artificial Sequence
  Synthetic Polynucleotide
tcttggacgt

SEQ ID NO: 2525 - DNA, 10 bp, Artificial Sequence
  Synthetic Polynucleotide
tcggtaaagc

SEQ ID NO: 2526 - DNA, 10 bp, Artificial Sequence
  Synthetic Polynucleotide
tgcagcattt

SEQ ID NO: 2527 - DNA, 10 bp, Artificial Sequence
  Synthetic Polynucleotide
tgcttgcttt

SEQ ID NO: 2528 - DNA, 10 bp, Artificial Sequence
  Synthetic Polynucleotide
acgttgccaa

SEQ ID NO: 2529 - DNA, 10 bp, Artificial Sequence
  Synthetic Polynucleotide
acaatgggga

SEQ ID NO: 2530 - DNA, 10 bp, Artificial Sequence
  Synthetic Polynucleotide
tcagcccaaa

SEQ ID NO: 2531 - DNA, 10 bp, Artificial Sequence
  Synthetic Polynucleotide
taagcgttcc

SEQ ID NO: 2532 - DNA, 10 bp, Artificial Sequence
  Synthetic Polynucleotide
aaacatcgcg

SEQ ID NO: 2533 - DNA, 10 bp, Artificial Sequence
  Synthetic Polynucleotide
tctcaatgcg

SEQ ID NO: 2534 - DNA, 10 bp, Artificial Sequence
  Synthetic Polynucleotide
tcgcaaccat

SEQ ID NO: 2535 - DNA, 10 bp, Artificial Sequence
  Synthetic Polynucleotide
cgcgttacag

SEQ ID NO: 2536 - DNA, 10 bp, Artificial Sequence
  Synthetic Polynucleotide
gtcggacagg

SEQ ID NO: 2537 - DNA, 10 bp, Artificial Sequence
  Synthetic Polynucleotide
gtgctacagc

SEQ ID NO: 2538 - DNA, 10 bp, Artificial Sequence
  Synthetic Polynucleotide
gctatctggc

SEQ ID NO: 2539 - DNA, 10 bp, Artificial Sequence
  Synthetic Polynucleotide
tcgctcaaag

SEQ ID NO: 2540 - DNA, 10 bp, Artificial Sequence
  Synthetic Polynucleotide
gaaatgccca

SEQ ID NO: 2541 - DNA, 10 bp, Artificial Sequence
  Synthetic Polynucleotide
gcgttcacta

SEQ ID NO: 2542 - DNA, 10 bp, Artificial Sequence
  Synthetic Polynucleotide
gccaacggtc

SEQ ID NO: 2543 - DNA, 10 bp, Artificial Sequence
  Synthetic Polynucleotide
actcggatcc

SEQ ID NO: 2544 - DNA, 10 bp, Artificial Sequence
  Synthetic Polynucleotide
cacagtcgca

SEQ ID NO: 2545 - DNA, 10 bp, Artificial Sequence
  Synthetic Polynucleotide
atgctcccgc

SEQ ID NO: 2546 - DNA, 10 bp, Artificial Sequence
  Synthetic Polynucleotide
gccgccttgt

SEQ ID NO: 2547 - DNA, 10 bp, Artificial Sequence
  Synthetic Polynucleotide
ctcaaagcgt

SEQ ID NO: 2548 - DNA, 10 bp, Artificial Sequence
  Synthetic Polynucleotide
cccgtcgcca

SEQ ID NO: 2549 - DNA, 10 bp, Artificial Sequence
  Synthetic Polynucleotide
cagcaagcaa

SEQ ID NO: 2550 - DNA, 10 bp, Artificial Sequence
  Synthetic Polynucleotide
gcgaactcca

SEQ ID NO: 2551 - DNA, 10 bp, Artificial Sequence
  Synthetic Polynucleotide
tcgatgctta

SEQ ID NO: 2552 - DNA, 10 bp, Artificial Sequence
  Synthetic Polynucleotide
acggacattg

SEQ ID NO: 2553 - DNA, 10 bp, Artificial Sequence
  Synthetic Polynucleotide
tggtggtgct

SEQ ID NO: 2554 - DNA, 10 bp, Artificial Sequence
  Synthetic Polynucleotide
cctctgaccc

SEQ ID NO: 2555 - DNA, 10 bp, Artificial Sequence
  Synthetic Polynucleotide
tcacgtcctg

SEQ ID NO: 2556 - DNA, 10 bp, Artificial Sequence
  Synthetic Polynucleotide
ccgggcacta

SEQ ID NO: 2557 - DNA, 10 bp, Artificial Sequence
  Synthetic Polynucleotide
tgttgacgcg

SEQ ID NO: 2558 - DNA, 10 bp, Artificial Sequence
  Synthetic Polynucleotide
tttgtagcgc

SEQ ID NO: 2559 - DNA, 10 bp, Artificial Sequence
  Synthetic Polynucleotide
tgttgtcagc

SEQ ID NO: 2560 - DNA, 10 bp, Artificial Sequence
  Synthetic Polynucleotide
tctcccatga

SEQ ID NO: 2561 - DNA, 10 bp, Artificial Sequence
  Synthetic Polynucleotide
tgactttgcg

SEQ ID NO: 2562 - DNA, 10 bp, Artificial Sequence
  Synthetic Polynucleotide
acttgacggg

SEQ ID NO: 2563 - DNA, 10 bp, Artificial Sequence
  Synthetic Polynucleotide
ccagcagcag

SEQ ID NO: 2564 - DNA, 10 bp, Artificial Sequence
  Synthetic Polynucleotide
tcacaagcct

SEQ ID NO: 2565 - DNA, 10 bp, Artificial Sequence
  Synthetic Polynucleotide
acacacgatg

SEQ ID NO: 2566 - DNA, 10 bp, Artificial Sequence
  Synthetic Polynucleotide
tctgggctct

SEQ ID NO: 2567 - DNA, 10 bp, Artificial Sequence
  Synthetic Polynucleotide
gtggtcgctc

SEQ ID NO: 2568 - DNA, 10 bp, Artificial Sequence
  Synthetic Polynucleotide
tgtcgccata

SEQ ID NO: 2569 - DNA, 10 bp, Artificial Sequence
  Synthetic Polynucleotide
aacggtgcgg

SEQ ID NO: 2570 - DNA, 10 bp, Artificial Sequence
  Synthetic Polynucleotide
gctagggtgg

SEQ ID NO: 2571 - DNA, 10 bp, Artificial Sequence
  Synthetic Polynucleotide
tgtggttgga

SEQ ID NO: 2572 - DNA, 10 bp, Artificial Sequence
  Synthetic Polynucleotide
tcgaagggac

SEQ ID NO: 2573 - DNA, 10 bp, Artificial Sequence
  Synthetic Polynucleotide
tgcgattgtt

SEQ ID NO: 2574 - DNA, 10 bp, Artificial Sequence
  Synthetic Polynucleotide
gcgcttgaat

SEQ ID NO: 2575 - DNA, 10 bp, Artificial Sequence
  Synthetic Polynucleotide
tccgttttga

SEQ ID NO: 2576 - DNA, 10 bp, Artificial Sequence
  Synthetic Polynucleotide
tcgcaagtca

SEQ ID NO: 2577 - DNA, 10 bp, Artificial Sequence
  Synthetic Polynucleotide
gccaatggtc

SEQ ID NO: 2578 - DNA, 10 bp, Artificial Sequence
  Synthetic Polynucleotide
ccgcctgaac

SEQ ID NO: 2579 - DNA, 10 bp, Artificial Sequence
  Synthetic Polynucleotide
acagccagtc

SEQ ID NO: 2580 - DNA, 10 bp, Artificial Sequence
  Synthetic Polynucleotide
cgattagccc

SEQ ID NO: 2581 - DNA, 10 bp, Artificial Sequence
  Synthetic Polynucleotide
gctacagcta

SEQ ID NO: 2582 - DNA, 10 bp, Artificial Sequence
  Synthetic Polynucleotide
gtgtcagcaa

SEQ ID NO: 2583 - DNA, 10 bp, Artificial Sequence
  Synthetic Polynucleotide
gcgaacagtg

SEQ ID NO: 2584 - DNA, 10 bp, Artificial Sequence
  Synthetic Polynucleotide
gccaatgtgg

SEQ ID NO: 2585 - DNA, 10 bp, Artificial Sequence
  Synthetic Polynucleotide
gatgccagtc

SEQ ID NO: 2586 - DNA, 10 bp, Artificial Sequence
  Synthetic Polynucleotide
acacgtcgag

SEQ ID NO: 2587 - DNA, 10 bp, Artificial Sequence
  Synthetic Polynucleotide
gaactgcctg

SEQ ID NO: 2588 - DNA, 10 bp, Artificial Sequence
  Synthetic Polynucleotide
acgttgccaa

SEQ ID NO: 2589 - DNA, 10 bp, Artificial Sequence
  Synthetic Polynucleotide
acaggaacca

SEQ ID NO: 2590 - DNA, 10 bp, Artificial Sequence
  Synthetic Polynucleotide
tgttgtcgta

SEQ ID NO: 2591 - DNA, 10 bp, Artificial Sequence
  Synthetic Polynucleotide
cgtcagccac

SEQ ID NO: 2592 - DNA, 10 bp, Artificial Sequence
  Synthetic Polynucleotide
agccgtcaat

SEQ ID NO: 2593 - DNA, 10 bp, Artificial Sequence
  Synthetic Polynucleotide
tgacaccagg

SEQ ID NO: 2594 - DNA, 10 bp, Artificial Sequence
  Synthetic Polynucleotide
gaggtacgct

SEQ ID NO: 2595 - DNA, 10 bp, Artificial Sequence
  Synthetic Polynucleotide
agcgaattgg

SEQ ID NO: 2596 - DNA, 10 bp, Artificial Sequence
  Synthetic Polynucleotide
gtcagggtgt

SEQ ID NO: 2597 - DNA, 10 bp, Artificial Sequence
  Synthetic Polynucleotide
atgttgacgc

SEQ ID NO: 2598 - DNA, 10 bp, Artificial Sequence
  Synthetic Polynucleotide
attacgccga

SEQ ID NO: 2599 - DNA, 10 bp, Artificial Sequence
  Synthetic Polynucleotide
cgtgcttaca

SEQ ID NO: 2600 - DNA, 10 bp, Artificial Sequence
  Synthetic Polynucleotide
tgctcaccat

SEQ ID NO: 2601 - DNA, 10 bp, Artificial Sequence
  Synthetic Polynucleotide
tgtgatgcca

SEQ ID NO: 2602 - DNA, 10 bp, Artificial Sequence
  Synthetic Polynucleotide
actccacacg

SEQ ID NO: 2603 - DNA, 10 bp, Artificial Sequence
  Synthetic Polynucleotide
cccgatctgt

SEQ ID NO: 2604 - DNA, 10 bp, Artificial Sequence
  Synthetic Polynucleotide
gcatcgaagc

SEQ ID NO: 2605 - DNA, 10 bp, Artificial Sequence
  Synthetic Polynucleotide
tgctaatcgc

SEQ ID NO: 2606 - DNA, 10 bp, Artificial Sequence
  Synthetic Polynucleotide
accaacggaa

SEQ ID NO: 2607 - DNA, 10 bp, Artificial Sequence
  Synthetic Polynucleotide
aggatggctt

SEQ ID NO: 2608 - DNA, 10 bp, Artificial Sequence
  Synthetic Polynucleotide
aacatgccca

SEQ ID NO: 2609 - DNA, 10 bp, Artificial Sequence
  Synthetic Polynucleotide
gattgcagca

SEQ ID NO: 2610 - DNA, 10 bp, Artificial Sequence
  Synthetic Polynucleotide
taacgctccc

SEQ ID NO: 2611 - DNA, 10 bp, Artificial Sequence
  Synthetic Polynucleotide
ctacggagga

SEQ ID NO: 2612 - DNA, 10 bp, Artificial Sequence
  Synthetic Polynucleotide
tgcagcttca

SEQ ID NO: 2613 - DNA, 10 bp, Artificial Sequence
  Synthetic Polynucleotide
cgcatttcca

SEQ ID NO: 2614 - DNA, 10 bp, Artificial Sequence
  Synthetic Polynucleotide
atgcacgcag

SEQ ID NO: 2615 - DNA, 10 bp, Artificial Sequence
  Synthetic Polynucleotide
aacgtgtcct

SEQ ID NO: 2616 - DNA, 10 bp, Artificial Sequence
  Synthetic Polynucleotide
tgtatccggc

SEQ ID NO: 2617 - DNA, 10 bp, Artificial Sequence
  Synthetic Polynucleotide
actccagccg

SEQ ID NO: 2618 - DNA, 10 bp, Artificial Sequence
  Synthetic Polynucleotide
taatgccgcg

SEQ ID NO: 2619 - DNA, 10 bp, Artificial Sequence
  Synthetic Polynucleotide
taaacctgcc

SEQ ID NO: 2620 - DNA, 10 bp, Artificial Sequence
  Synthetic Polynucleotide
cagccttctg

SEQ ID NO: 2621 - DNA, 10 bp, Artificial Sequence
  Synthetic Polynucleotide
gtcaagagcc

SEQ ID NO: 2622 - DNA, 10 bp, Artificial Sequence
  Synthetic Polynucleotide
atccaccgta

SEQ ID NO: 2623 - DNA, 10 bp, Artificial Sequence
  Synthetic Polynucleotide
gggttgatgg

SEQ ID NO: 2624 - DNA, 10 bp, Artificial Sequence
  Synthetic Polynucleotide
tctaccagca

SEQ ID NO: 2625 - DNA, 10 bp, Artificial Sequence
  Synthetic Polynucleotide
cacgcaatgc

SEQ ID NO: 2626 - DNA, 10 bp, Artificial Sequence
  Synthetic Polynucleotide
ctggttgcac

SEQ ID NO: 2627 - DNA, 10 bp, Artificial Sequence
  Synthetic Polynucleotide
caccagacga

SEQ ID NO: 2628 - DNA, 10 bp, Artificial Sequence
  Synthetic Polynucleotide
cgtcaaagct

SEQ ID NO: 2629 - DNA, 10 bp, Artificial Sequence
  Synthetic Polynucleotide
accccttcta

SEQ ID NO: 2630 - DNA, 10 bp, Artificial Sequence
  Synthetic Polynucleotide
cacgccttgt

SEQ ID NO: 2631 - DNA, 10 bp, Artificial Sequence
  Synthetic Polynucleotide
ggagaggagg

SEQ ID NO: 2632 - DNA, 10 bp, Artificial Sequence
  Synthetic Polynucleotide
cgtcaactgt

SEQ ID NO: 2633 - DNA, 10 bp, Artificial Sequence
  Synthetic Polynucleotide
gcaaaacgtg

SEQ ID NO: 2634 - DNA, 10 bp, Artificial Sequence
  Synthetic Polynucleotide
tacgcatcaa

SEQ ID NO: 2635 - DNA, 10 bp, Artificial Sequence
  Synthetic Polynucleotide
cgaccaacaa

SEQ ID NO: 2636 - DNA, 10 bp, Artificial Sequence
  Synthetic Polynucleotide
tttctgctgc

SEQ ID NO: 2637 - DNA, 10 bp, Artificial Sequence
  Synthetic Polynucleotide
tgctgatgga

SEQ ID NO: 2638 - DNA, 10 bp, Artificial Sequence
  Synthetic Polynucleotide
tctgtcgcca

SEQ ID NO: 2639 - DNA, 10 bp, Artificial Sequence
  Synthetic Polynucleotide
tcatggatgc

SEQ ID NO: 2640 - DNA, 10 bp, Artificial Sequence
  Synthetic Polynucleotide
attgacgcac

SEQ ID NO: 2641 - DNA, 10 bp, Artificial Sequence
  Synthetic Polynucleotide
tcctccaccc

SEQ ID NO: 2642 - DNA, 10 bp, Artificial Sequence
  Synthetic Polynucleotide
ctgattggca

SEQ ID NO: 2643 - DNA, 10 bp, Artificial Sequence
  Synthetic Polynucleotide
cgcaggttgg

SEQ ID NO: 2644 - DNA, 10 bp, Artificial Sequence
  Synthetic Polynucleotide
cctgatccca

SEQ ID NO: 2645 - DNA, 10 bp, Artificial Sequence
  Synthetic Polynucleotide
tagccgttgg

SEQ ID NO: 2646 - DNA, 10 bp, Artificial Sequence
  Synthetic Polynucleotide
tccagctcag

SEQ ID NO: 2647 - DNA, 10 bp, Artificial Sequence
  Synthetic Polynucleotide
accactgagc

SEQ ID NO: 2648 - DNA, 10 bp, Artificial Sequence
  Synthetic Polynucleotide
tcaggacgta

SEQ ID NO: 2649 - DNA, 10 bp, Artificial Sequence
  Synthetic Polynucleotide
gctagaccga

SEQ ID NO: 2650 - DNA, 10 bp, Artificial Sequence
  Synthetic Polynucleotide
tgcgggttcg

SEQ ID NO: 2651 - DNA, 10 bp, Artificial Sequence
  Synthetic Polynucleotide
cgcaagacaa

SEQ ID NO: 2652 - DNA, 10 bp, Artificial Sequence
  Synthetic Polynucleotide
cccattgacc

SEQ ID NO: 2653 - DNA, 10 bp, Artificial Sequence
  Synthetic Polynucleotide
tgcaagatgg

SEQ ID NO: 2654 - DNA, 10 bp, Artificial Sequence
  Synthetic Polynucleotide
ggcagagtta

SEQ ID NO: 2655 - DNA, 10 bp, Artificial Sequence
  Synthetic Polynucleotide
cgtaccacga

SEQ ID NO: 2656 - DNA, 10 bp, Artificial Sequence
  Synthetic Polynucleotide
tgacccggtg

SEQ ID NO: 2657 - DNA, 10 bp, Artificial Sequence
  Synthetic Polynucleotide
cgattagcgg

SEQ ID NO: 2658 - DNA, 10 bp, Artificial Sequence
  Synthetic Polynucleotide
ttcgtcaggc

SEQ ID NO: 2659 - DNA, 10 bp, Artificial Sequence
  Synthetic Polynucleotide
tggctcagca

SEQ ID NO: 2660 - DNA, 10 bp, Artificial Sequence
  Synthetic Polynucleotide
tggtggatcc

SEQ ID NO: 2661 - DNA, 10 bp, Artificial Sequence
  Synthetic Polynucleotide
ggaaacacgc

SEQ ID NO: 2662 - DNA, 10 bp, Artificial Sequence
  Synthetic Polynucleotide
tatgcacagc

SEQ ID NO: 2663 - DNA, 10 bp, Artificial Sequence
  Synthetic Polynucleotide
tggctttcgt

SEQ ID NO: 2664 - DNA, 10 bp, Artificial Sequence
  Synthetic Polynucleotide
tgttgcgatt

SEQ ID NO: 2665 - DNA, 10 bp, Artificial Sequence
  Synthetic Polynucleotide
tgcgtctact

SEQ ID NO: 2666 - DNA, 10 bp, Artificial Sequence
  Synthetic Polynucleotide
tttcacgcct

SEQ ID NO: 2667 - DNA, 10 bp, Artificial Sequence
  Synthetic Polynucleotide
gcagcgaggt

SEQ ID NO: 2668 - DNA, 10 bp, Artificial Sequence
  Synthetic Polynucleotide
gctatcggta

SEQ ID NO: 2669 - DNA, 10 bp, Artificial Sequence
  Synthetic Polynucleotide
tgggttgtga

SEQ ID NO: 2670 - DNA, 10 bp, Artificial Sequence
  Synthetic Polynucleotide
tgggtggaag

SEQ ID NO: 2671 - DNA, 10 bp, Artificial Sequence
  Synthetic Polynucleotide
tcgtagtcca

SEQ ID NO: 2672 - DNA, 10 bp, Artificial Sequence
  Synthetic Polynucleotide
ccttcccctt

SEQ ID NO: 2673 - DNA, 10 bp, Artificial Sequence
  Synthetic Polynucleotide
cctgcgaacg

SEQ ID NO: 2674 - DNA, 10 bp, Artificial Sequence
  Synthetic Polynucleotide
gcggcttcaa

SEQ ID NO: 2675 - DNA, 10 bp, Artificial Sequence
  Synthetic Polynucleotide
agctgtcaga

SEQ ID NO: 2676 - DNA, 10 bp, Artificial Sequence
  Synthetic Polynucleotide
ccctgatgct

SEQ ID NO: 2677 - DNA, 10 bp, Artificial Sequence
  Synthetic Polynucleotide
tcattgtggc

SEQ ID NO: 2678 - DNA, 10 bp, Artificial Sequence
  Synthetic Polynucleotide
gagcgatgca

SEQ ID NO: 2679 - DNA, 10 bp, Artificial Sequence
  Synthetic Polynucleotide
ccctcgtagc

SEQ ID NO: 2680 - DNA, 10 bp, Artificial Sequence
  Synthetic Polynucleotide
tgggtgacaa

SEQ ID NO: 2681 - DNA, 10 bp, Artificial Sequence
  Synthetic Polynucleotide
ggtgtgcctg

SEQ ID NO: 2682 - DNA, 10 bp, Artificial Sequence
  Synthetic Polynucleotide
ttggggatcc

SEQ ID NO: 2683 - DNA, 10 bp, Artificial Sequence
  Synthetic Polynucleotide
gagggatgca

SEQ ID NO: 2684 - DNA, 10 bp, Artificial Sequence
  Synthetic Polynucleotide
tcaactcagc

SEQ ID NO: 2685 - DNA, 10 bp, Artificial Sequence
  Synthetic Polynucleotide
agacggaagt

SEQ ID NO: 2686 - DNA, 10 bp, Artificial Sequence
  Synthetic Polynucleotide
taccaagcta

SEQ ID NO: 2687 - DNA, 10 bp, Artificial Sequence
  Synthetic Polynucleotide
acagatggga

SEQ ID NO: 2688 - DNA, 10 bp, Artificial Sequence
  Synthetic Polynucleotide
ccactccaca

SEQ ID NO: 2689 - DNA, 10 bp, Artificial Sequence
  Synthetic Polynucleotide
attcgctggt

SEQ ID NO: 2690 - DNA, 10 bp, Artificial Sequence
  Synthetic Polynucleotide
cccttccgtt

SEQ ID NO: 2691 - DNA, 10 bp, Artificial Sequence
  Synthetic Polynucleotide
tggaggaaga

SEQ ID NO: 2692 - DNA, 10 bp, Artificial Sequence
  Synthetic Polynucleotide
tccacaagct

SEQ ID NO: 2693 - DNA, 10 bp, Artificial Sequence
  Synthetic Polynucleotide
tgttgcgggg

SEQ ID NO: 2694 - DNA, 10 bp, Artificial Sequence
  Synthetic Polynucleotide
cttcgagcag

SEQ ID NO: 2695 - DNA, 10 bp, Artificial Sequence
  Synthetic Polynucleotide
ccaccaaaca

SEQ ID NO: 2696 - DNA, 10 bp, Artificial Sequence
  Synthetic Polynucleotide
catggaagcc

SEQ ID NO: 2697 - DNA, 10 bp, Artificial Sequence
  Synthetic Polynucleotide
tggcggtgtg

SEQ ID NO: 2698 - DNA, 10 bp, Artificial Sequence
  Synthetic Polynucleotide
acctcaagcg

SEQ ID NO: 2699 - DNA, 10 bp, Artificial Sequence
  Synthetic Polynucleotide
aagaggcgtt

SEQ ID NO: 2700 - DNA, 10 bp, Artificial Sequence
  Synthetic Polynucleotide
cgtctcatcg

SEQ ID NO: 2701 - DNA, 10 bp, Artificial Sequence
  Synthetic Polynucleotide
tggtcgtgaa

SEQ ID NO: 2702 - DNA, 10 bp, Artificial Sequence
  Synthetic Polynucleotide
tccagttgca

SEQ ID NO: 2703 - DNA, 10 bp, Artificial Sequence
  Synthetic Polynucleotide
acgaatggcg

SEQ ID NO: 2704 - DNA, 10 bp, Artificial Sequence
  Synthetic Polynucleotide
gaagcatgga

SEQ ID NO: 2705 - DNA, 10 bp, Artificial Sequence
  Synthetic Polynucleotide
acggatcgta

SEQ ID NO: 2706 - DNA, 10 bp, Artificial Sequence
  Synthetic Polynucleotide
ggcatgtccg

SEQ ID NO: 2707 - DNA, 10 bp, Artificial Sequence
  Synthetic Polynucleotide
gcaagctgat

SEQ ID NO: 2708 - DNA, 10 bp, Artificial Sequence
  Synthetic Polynucleotide
atgaccgtga

SEQ ID NO: 2709 - DNA, 10 bp, Artificial Sequence
  Synthetic Polynucleotide
ggctcagatg

SEQ ID NO: 2710 - DNA, 10 bp, Artificial Sequence
  Synthetic Polynucleotide
ctgttccagc

SEQ ID NO: 2711 - DNA, 10 bp, Artificial Sequence
  Synthetic Polynucleotide
ggtggaggat

SEQ ID NO: 2712 - DNA, 10 bp, Artificial Sequence
  Synthetic Polynucleotide
caaccacgtc

SEQ ID NO: 2713 - DNA, 10 bp, Artificial Sequence
  Synthetic Polynucleotide
tggatggcta

SEQ ID NO: 2714 - DNA, 10 bp, Artificial Sequence
  Synthetic Polynucleotide
tgagcgattg

SEQ ID NO: 2715 - DNA, 10 bp, Artificial Sequence
  Synthetic Polynucleotide
ttgagcgagt

SEQ ID NO: 2716 - DNA, 10 bp, Artificial Sequence
  Synthetic Polynucleotide
gggtcgggtg

SEQ ID NO: 2717 - DNA, 10 bp, Artificial Sequence
  Synthetic Polynucleotide
acgaagacga

SEQ ID NO: 2718 - DNA, 10 bp, Artificial Sequence
  Synthetic Polynucleotide
gcaccttcac

SEQ ID NO: 2719 - DNA, 10 bp, Artificial Sequence
  Synthetic Polynucleotide
gatgtgccag

SEQ ID NO: 2720 - DNA, 10 bp, Artificial Sequence
  Synthetic Polynucleotide
tgtcgtagga

SEQ ID NO: 2721 - DNA, 10 bp, Artificial Sequence
  Synthetic Polynucleotide
cgtcaggaac

SEQ ID NO: 2722 - DNA, 10 bp, Artificial Sequence
  Synthetic Polynucleotide
tcacgtttgg

SEQ ID NO: 2723 - DNA, 10 bp, Artificial Sequence
  Synthetic Polynucleotide
agagcagacg

SEQ ID NO: 2724 - DNA, 10 bp, Artificial Sequence
  Synthetic Polynucleotide
ttggcgtgtg

SEQ ID NO: 2725 - DNA, 10 bp, Artificial Sequence
  Synthetic Polynucleotide
tgagcgtaga

SEQ ID NO: 2726 - DNA, 10 bp, Artificial Sequence
  Synthetic Polynucleotide
tgatgtccca

SEQ ID NO: 2727 - DNA, 10 bp, Artificial Sequence
  Synthetic Polynucleotide
tccctgtgcg

SEQ ID NO: 2728 - DNA, 10 bp, Artificial Sequence
  Synthetic Polynucleotide
ggcagagcag

SEQ ID NO: 2729 - DNA, 10 bp, Artificial Sequence
  Synthetic Polynucleotide
tactcgcctt

SEQ ID NO: 2730 - DNA, 10 bp, Artificial Sequence
  Synthetic Polynucleotide
ttctgtgtgc

SEQ ID NO: 2731 - DNA, 10 bp, Artificial Sequence
  Synthetic Polynucleotide
agacgctggt

SEQ ID NO: 2732 - DNA, 10 bp, Artificial Sequence
  Synthetic Polynucleotide
cccgcatgat

SEQ ID NO: 2733 - DNA, 10 bp, Artificial Sequence
  Synthetic Polynucleotide
cgctcatcct

SEQ ID NO: 2734 - DNA, 10 bp, Artificial Sequence
  Synthetic Polynucleotide
gtccatccca

SEQ ID NO: 2735 - DNA, 10 bp, Artificial Sequence
  Synthetic Polynucleotide
acgattggtg

SEQ ID NO: 2736 - DNA, 10 bp, Artificial Sequence
  Synthetic Polynucleotide
atgcaacgta

SEQ ID NO: 2737 - DNA, 10 bp, Artificial Sequence
  Synthetic Polynucleotide
acgtggattg

SEQ ID NO: 2738 - DNA, 10 bp, Artificial Sequence
  Synthetic Polynucleotide
gtcaactcgg

SEQ ID NO: 2739 - DNA, 10 bp, Artificial Sequence
  Synthetic Polynucleotide
tgagtgggag

SEQ ID NO: 2740 - DNA, 10 bp, Artificial Sequence
  Synthetic Polynucleotide
aacgcctctt

SEQ ID NO: 2741 - DNA, 10 bp, Artificial Sequence
  Synthetic Polynucleotide
tgcttttcga

SEQ ID NO: 2742 - DNA, 10 bp, Artificial Sequence
  Synthetic Polynucleotide
gtcggtccta

SEQ ID NO: 2743 - DNA, 10 bp, Artificial Sequence
  Synthetic Polynucleotide
agttggtgca

SEQ ID NO: 2744 - DNA, 10 bp, Artificial Sequence
  Synthetic Polynucleotide
gtcgtcacca

SEQ ID NO: 2745 - DNA, 10 bp, Artificial Sequence
  Synthetic Polynucleotide
tgcgaacagt

SEQ ID NO: 2746 - DNA, 10 bp, Artificial Sequence
  Synthetic Polynucleotide
cgacgctaat

SEQ ID NO: 2747 - DNA, 10 bp, Artificial Sequence
  Synthetic Polynucleotide
gtgcagatgg

SEQ ID NO: 2748 - DNA, 10 bp, Artificial Sequence
  Synthetic Polynucleotide
aaccacctca

SEQ ID NO: 2749 - DNA, 10 bp, Artificial Sequence
  Synthetic Polynucleotide
cgatggcgtt

SEQ ID NO: 2750 - DNA, 10 bp, Artificial Sequence
  Synthetic Polynucleotide
gtagcgtcag

SEQ ID NO: 2751 - DNA, 10 bp, Artificial Sequence
  Synthetic Polynucleotide
gcttgagtgg

SEQ ID NO: 2752 - DNA, 10 bp, Artificial Sequence
  Synthetic Polynucleotide
cgtccgaagt

SEQ ID NO: 2753 - DNA, 10 bp, Artificial Sequence
  Synthetic Polynucleotide
tggaagcagc

SEQ ID NO: 2754 - DNA, 10 bp, Artificial Sequence
  Synthetic Polynucleotide
gcccggtaga

SEQ ID NO: 2755 - DNA, 10 bp, Artificial Sequence
  Synthetic Polynucleotide
tctcgctttg

SEQ ID NO: 2756 - DNA, 10 bp, Artificial Sequence
  Synthetic Polynucleotide
cagaagtgca

SEQ ID NO: 2757 - DNA, 10 bp, Artificial Sequence
  Synthetic Polynucleotide
tcctcgttgt

SEQ ID NO: 2758 - DNA, 10 bp, Artificial Sequence
  Synthetic Polynucleotide
tgcatccact

SEQ ID NO: 2759 - DNA, 10 bp, Artificial Sequence
  Synthetic Polynucleotide
cagttgggtg

SEQ ID NO: 2760 - DNA, 10 bp, Artificial Sequence
  Synthetic Polynucleotide
tggtacaccc

SEQ ID NO: 2761 - DNA, 10 bp, Artificial Sequence
  Synthetic Polynucleotide
agcttgtgga

SEQ ID NO: 2762 - DNA, 10 bp, Artificial Sequence
  Synthetic Polynucleotide
gcatctcgtt

SEQ ID NO: 2763 - DNA, 10 bp, Artificial Sequence
  Synthetic Polynucleotide
cgtaagctgg

SEQ ID NO: 2764 - DNA, 10 bp, Artificial Sequence
  Synthetic Polynucleotide
cctgagccag

SEQ ID NO: 2765 - DNA, 10 bp, Artificial Sequence
  Synthetic Polynucleotide
tgctgagtgg

SEQ ID NO: 2766 - DNA, 10 bp, Artificial Sequence
  Synthetic Polynucleotide
ccgttgcaag

SEQ ID NO: 2767 - DNA, 10 bp, Artificial Sequence
  Synthetic Polynucleotide
tatgtggccc

SEQ ID NO: 2768 - DNA, 10 bp, Artificial Sequence
  Synthetic Polynucleotide
taccctcctt

SEQ ID NO: 2769 - DNA, 10 bp, Artificial Sequence
  Synthetic Polynucleotide
cggttatggg

SEQ ID NO: 2770 - DNA, 10 bp, Artificial Sequence
  Synthetic Polynucleotide
tcatcaagcc

SEQ ID NO: 2771 - DNA, 10 bp, Artificial Sequence
  Synthetic Polynucleotide
cggacaatga

SEQ ID NO: 2772 - DNA, 10 bp, Artificial Sequence
  Synthetic Polynucleotide
cacctgccat

SEQ ID NO: 2773 - DNA, 10 bp, Artificial Sequence
  Synthetic Polynucleotide
acgacgttcg

SEQ ID NO: 2774 - DNA, 10 bp, Artificial Sequence
  Synthetic Polynucleotide
tcttgggcaa

SEQ ID NO: 2775 - DNA, 10 bp, Artificial Sequence
  Synthetic Polynucleotide
gtgtggttga

SEQ ID NO: 2776 - DNA, 10 bp, Artificial Sequence
  Synthetic Polynucleotide
ggatgctcgt

SEQ ID NO: 2777 - DNA, 10 bp, Artificial Sequence
  Synthetic Polynucleotide
cgatgccact

SEQ ID NO: 2778 - DNA, 10 bp, Artificial Sequence
  Synthetic Polynucleotide
ctcgcctttc

SEQ ID NO: 2779 - DNA, 10 bp, Artificial Sequence
  Synthetic Polynucleotide
gacggtcagt

SEQ ID NO: 2780 - DNA, 10 bp, Artificial Sequence
  Synthetic Polynucleotide
ctgctcagtc

SEQ ID NO: 2781 - DNA, 10 bp, Artificial Sequence
  Synthetic Polynucleotide
aaccccggtg

SEQ ID NO: 2782 - DNA, 10 bp, Artificial Sequence
  Synthetic Polynucleotide
tgagtgggtg

SEQ ID NO: 2783 - DNA, 10 bp, Artificial Sequence
  Synthetic Polynucleotide
gagttagccg

SEQ ID NO: 2784 - DNA, 10 bp, Artificial Sequence
  Synthetic Polynucleotide
ctctggctga

SEQ ID NO: 2785 - DNA, 10 bp, Artificial Sequence
  Synthetic Polynucleotide
ctgggatgga

SEQ ID NO: 2786 - DNA, 10 bp, Artificial Sequence
  Synthetic Polynucleotide
tgcgacaatc

SEQ ID NO: 2787 - DNA, 10 bp, Artificial Sequence
  Synthetic Polynucleotide
tggtgagaga

SEQ ID NO: 2788 - DNA, 10 bp, Artificial Sequence
  Synthetic Polynucleotide
tggtctagcg

SEQ ID NO: 2789 - DNA, 10 bp, Artificial Sequence
  Synthetic Polynucleotide
ggacatgcct

SEQ ID NO: 2790 - DNA, 10 bp, Artificial Sequence
  Synthetic Polynucleotide
cgtagctgta

SEQ ID NO: 2791 - DNA, 10 bp, Artificial Sequence
  Synthetic Polynucleotide
tgaaacggca

SEQ ID NO: 2792 - DNA, 10 bp, Artificial Sequence
  Synthetic Polynucleotide
tcggctcctt

SEQ ID NO: 2793 - DNA, 10 bp, Artificial Sequence
  Synthetic Polynucleotide
gatgcggata

SEQ ID NO: 2794 - DNA, 10 bp, Artificial Sequence
  Synthetic Polynucleotide
catcgccaaa

SEQ ID NO: 2795 - DNA, 10 bp, Artificial Sequence
  Synthetic Polynucleotide
ggttgatgca

SEQ ID NO: 2796 - DNA, 10 bp, Artificial Sequence
  Synthetic Polynucleotide
tccatcagca

SEQ ID NO: 2797 - DNA, 10 bp, Artificial Sequence
  Synthetic Polynucleotide
acccacgtca

SEQ ID NO: 2798 - DNA, 10 bp, Artificial Sequence
  Synthetic Polynucleotide
caacacgaga

SEQ ID NO: 2799 - DNA, 10 bp, Artificial Sequence
  Synthetic Polynucleotide
tgtgatgcag

SEQ ID NO: 2800 - DNA, 10 bp, Artificial Sequence
  Synthetic Polynucleotide
ccaccctccc

SEQ ID NO: 2801 - DNA, 10 bp, Artificial Sequence
  Synthetic Polynucleotide
ggtgacatcg

SEQ ID NO: 2802 - DNA, 10 bp, Artificial Sequence
  Synthetic Polynucleotide
cacgcttaca

SEQ ID NO: 2803 - DNA, 10 bp, Artificial Sequence
  Synthetic Polynucleotide
tcagacggtg

SEQ ID NO: 2804 - DNA, 10 bp, Artificial Sequence
  Synthetic Polynucleotide
ccacatgctc

SEQ ID NO: 2805 - DNA, 10 bp, Artificial Sequence
  Synthetic Polynucleotide
gtgactccct

SEQ ID NO: 2806 - DNA, 10 bp, Artificial Sequence
  Synthetic Polynucleotide
gtccttgggc

SEQ ID NO: 2807 - DNA, 10 bp, Artificial Sequence
  Synthetic Polynucleotide
tggcttacca

SEQ ID NO: 2808 - DNA, 10 bp, Artificial Sequence
  Synthetic Polynucleotide
ctgccatctg

SEQ ID NO: 2809 - DNA, 10 bp, Artificial Sequence
  Synthetic Polynucleotide
ggggattggg

SEQ ID NO: 2810 - DNA, 10 bp, Artificial Sequence
  Synthetic Polynucleotide
tcctctgtca

SEQ ID NO: 2811 - DNA, 10 bp, Artificial Sequence
  Synthetic Polynucleotide
tggggaaaga

SEQ ID NO: 2812 - DNA, 10 bp, Artificial Sequence
  Synthetic Polynucleotide
gtggtccctg

SEQ ID NO: 2813 - DNA, 10 bp, Artificial Sequence
  Synthetic Polynucleotide
tccttgggag

SEQ ID NO: 2814 - DNA, 10 bp, Artificial Sequence
  Synthetic Polynucleotide
ctgcttgccc

SEQ ID NO: 2815 - DNA, 10 bp, Artificial Sequence
  Synthetic Polynucleotide
gcgagagcgt

SEQ ID NO: 2816 - DNA, 10 bp, Artificial Sequence
  Synthetic Polynucleotide
ctgttcgggc

SEQ ID NO: 2817 - DNA, 10 bp, Artificial Sequence
  Synthetic Polynucleotide
gcttgcttgc

SEQ ID NO: 2818 - DNA, 10 bp, Artificial Sequence
  Synthetic Polynucleotide
tggggtcaaa

SEQ ID NO: 2819 - DNA, 10 bp, Artificial Sequence
  Synthetic Polynucleotide
ctcgtccggg

SEQ ID NO: 2820 - DNA, 10 bp, Artificial Sequence
  Synthetic Polynucleotide
atgacggctt

SEQ ID NO: 2821 - DNA, 10 bp, Artificial Sequence
  Synthetic Polynucleotide
gcgtggcgat

SEQ ID NO: 2822 - DNA, 10 bp, Artificial Sequence
  Synthetic Polynucleotide
ccatttgcca

SEQ ID NO: 2823 - DNA, 10 bp, Artificial Sequence
  Synthetic Polynucleotide
ggggatgtca

SEQ ID NO: 2824 - DNA, 10 bp, Artificial Sequence
  Synthetic Polynucleotide
cccttgtggt

SEQ ID NO: 2825 - DNA, 10 bp, Artificial Sequence
  Synthetic Polynucleotide
tgtcaggaca

SEQ ID NO: 2826 - DNA, 10 bp, Artificial Sequence
  Synthetic Polynucleotide
ccaggttgta

SEQ ID NO: 2827 - DNA, 10 bp, Artificial Sequence
  Synthetic Polynucleotide
atcagtggcc

SEQ ID NO: 2828 - DNA, 10 bp, Artificial Sequence
  Synthetic Polynucleotide
agccactccc

SEQ ID NO: 2829 - DNA, 10 bp, Artificial Sequence
  Synthetic Polynucleotide
agggaggact

SEQ ID NO: 2830 - DNA, 10 bp, Artificial Sequence
  Synthetic Polynucleotide
ggccattgtt

SEQ ID NO: 2831 - DNA, 10 bp, Artificial Sequence
  Synthetic Polynucleotide
acaggagcag

SEQ ID NO: 2832 - DNA, 10 bp, Artificial Sequence
  Synthetic Polynucleotide
tgtccaggca

SEQ ID NO: 2833 - DNA, 10 bp, Artificial Sequence
  Synthetic Polynucleotide
ctggaccctc

SEQ ID NO: 2834 - DNA, 10 bp, Artificial Sequence
  Synthetic Polynucleotide
gatcaggccc

SEQ ID NO: 2835 - DNA, 10 bp, Artificial Sequence
  Synthetic Polynucleotide
aaatcagccg

SEQ ID NO: 2836 - DNA, 10 bp, Artificial Sequence
  Synthetic Polynucleotide
tctgtctggt

SEQ ID NO: 2837 - DNA, 10 bp, Artificial Sequence
  Synthetic Polynucleotide
tcctcggaaa

SEQ ID NO: 2838 - DNA, 10 bp, Artificial Sequence
  Synthetic Polynucleotide
ttgtgcccaa

SEQ ID NO: 2839 - DNA, 10 bp, Artificial Sequence
  Synthetic Polynucleotide
tggaccagga

SEQ ID NO: 2840 - DNA, 10 bp, Artificial Sequence
  Synthetic Polynucleotide
ccccagagtc

SEQ ID NO: 2841 - DNA, 10 bp, Artificial Sequence
  Synthetic Polynucleotide
agaagcagcc

SEQ ID NO: 2842 - DNA, 10 bp, Artificial Sequence
  Synthetic Polynucleotide
gccccacgtt

SEQ ID NO: 2843 - DNA, 10 bp, Artificial Sequence
  Synthetic Polynucleotide
tcgagaacca

SEQ ID NO: 2844 - DNA, 10 bp, Artificial Sequence
  Synthetic Polynucleotide
tcccttccac

SEQ ID NO: 2845 - DNA, 10 bp, Artificial Sequence
  Synthetic Polynucleotide
gcatgttggt

SEQ ID NO: 2846 - DNA, 10 bp, Artificial Sequence
  Synthetic Polynucleotide
accctgttgg

SEQ ID NO: 2847 - DNA, 10 bp, Artificial Sequence
  Synthetic Polynucleotide
agggacttga

SEQ ID NO: 2848 - DNA, 10 bp, Artificial Sequence
  Synthetic Polynucleotide
ggacgagccc

SEQ ID NO: 2849 - DNA, 10 bp, Artificial Sequence
  Synthetic Polynucleotide
tcgtggtctc

SEQ ID NO: 2850 - DNA, 10 bp, Artificial Sequence
  Synthetic Polynucleotide
attggggagc

SEQ ID NO: 2851 - DNA, 10 bp, Artificial Sequence
  Synthetic Polynucleotide
aacccctcct

SEQ ID NO: 2852 - DNA, 10 bp, Artificial Sequence
  Synthetic Polynucleotide
gtctctgggt

SEQ ID NO: 2853 - DNA, 10 bp, Artificial Sequence
  Synthetic Polynucleotide
ccagaccctg

SEQ ID NO: 2854 - DNA, 10 bp, Artificial Sequence
  Synthetic Polynucleotide
ttggtccagc

SEQ ID NO: 2855 - DNA, 10 bp, Artificial Sequence
  Synthetic Polynucleotide
gacattgggg

SEQ ID NO: 2856 - DNA, 10 bp, Artificial Sequence
  Synthetic Polynucleotide
ccaccattcc

SEQ ID NO: 2857 - DNA, 10 bp, Artificial Sequence
  Synthetic Polynucleotide
ccattgtggc

SEQ ID NO: 2858 - DNA, 10 bp, Artificial Sequence
  Synthetic Polynucleotide
gctcagttcc

SEQ ID NO: 2859 - DNA, 10 bp, Artificial Sequence
  Synthetic Polynucleotide
gtgtagccct

SEQ ID NO: 2860 - DNA, 10 bp, Artificial Sequence
  Synthetic Polynucleotide
gggtccctgc

SEQ ID NO: 2861 - DNA, 10 bp, Artificial Sequence
  Synthetic Polynucleotide
tgcccaccag

SEQ ID NO: 2862 - DNA, 10 bp, Artificial Sequence
  Synthetic Polynucleotide
gactcctggt

SEQ ID NO: 2863 - DNA, 10 bp, Artificial Sequence
  Synthetic Polynucleotide
acttcctccc

SEQ ID NO: 2864 - DNA, 10 bp, Artificial Sequence
  Synthetic Polynucleotide
ggcgatcagt

SEQ ID NO: 2865 - DNA, 10 bp, Artificial Sequence
  Synthetic Polynucleotide
aggaaaggcc

SEQ ID NO: 2866 - DNA, 10 bp, Artificial Sequence
  Synthetic Polynucleotide
ctctctgcct

SEQ ID NO: 2867 - DNA, 10 bp, Artificial Sequence
  Synthetic Polynucleotide
caggcagcag

SEQ ID NO: 2868 - DNA, 10 bp, Artificial Sequence
  Synthetic Polynucleotide
cctagccagg

SEQ ID NO: 2869 - DNA, 10 bp, Artificial Sequence
  Synthetic Polynucleotide
atgcagggcc

SEQ ID NO: 2870 - DNA, 10 bp, Artificial Sequence
  Synthetic Polynucleotide
cccactgtgt

SEQ ID NO: 2871 - DNA, 10 bp, Artificial Sequence
  Synthetic Polynucleotide
ggctttcagc

SEQ ID NO: 2872 - DNA, 10 bp, Artificial Sequence
  Synthetic Polynucleotide
tccagtgaga

SEQ ID NO: 2873 - DNA, 10 bp, Artificial Sequence
  Synthetic Polynucleotide
aggcacttca

SEQ ID NO: 2874 - DNA, 10 bp, Artificial Sequence
  Synthetic Polynucleotide
ccccagaagt

SEQ ID NO: 2875 - DNA, 10 bp, Artificial Sequence
  Synthetic Polynucleotide
caaggccgat

SEQ ID NO: 2876 - DNA, 10 bp, Artificial Sequence
  Synthetic Polynucleotide
atgcaggtga

SEQ ID NO: 2877 - DNA, 10 bp, Artificial Sequence
  Synthetic Polynucleotide
gggacaggaa

SEQ ID NO: 2878 - DNA, 10 bp, Artificial Sequence
  Synthetic Polynucleotide
ggcttctccc

SEQ ID NO: 2879 - DNA, 10 bp, Artificial Sequence
  Synthetic Polynucleotide
ggcagttgag

SEQ ID NO: 2880 - DNA, 10 bp, Artificial Sequence
  Synthetic Polynucleotide
tcccctccag

SEQ ID NO: 2881 - DNA, 10 bp, Artificial Sequence
  Synthetic Polynucleotide
tgaccgagat

SEQ ID NO: 2882 - DNA, 10 bp, Artificial Sequence
  Synthetic Polynucleotide
tggtggtctt

SEQ ID NO: 2883 - DNA, 10 bp, Artificial Sequence
  Synthetic Polynucleotide
tggaagacga

SEQ ID NO: 2884 - DNA, 10 bp, Artificial Sequence
  Synthetic Polynucleotide
atcctcccct

SEQ ID NO: 2885 - DNA, 10 bp, Artificial Sequence
  Synthetic Polynucleotide
aattgcagcc

SEQ ID NO: 2886 - DNA, 10 bp, Artificial Sequence
  Synthetic Polynucleotide
tcaatccccg

SEQ ID NO: 2887 - DNA, 10 bp, Artificial Sequence
  Synthetic Polynucleotide
catccgaggt

SEQ ID NO: 2888 - DNA, 10 bp, Artificial Sequence
  Synthetic Polynucleotide
attcagccca

SEQ ID NO: 2889 - DNA, 10 bp, Artificial Sequence
  Synthetic Polynucleotide
agtggcggaa

SEQ ID NO: 2890 - DNA, 10 bp, Artificial Sequence
  Synthetic Polynucleotide
taagggtcca

SEQ ID NO: 2891 - DNA, 10 bp, Artificial Sequence
  Synthetic Polynucleotide
gcatctgagc

SEQ ID NO: 2892 - DNA, 10 bp, Artificial Sequence
  Synthetic Polynucleotide
cgtcctgtgc

SEQ ID NO: 2893 - DNA, 10 bp, Artificial Sequence
  Synthetic Polynucleotide
gcaggcagca

SEQ ID NO: 2894 - DNA, 10 bp, Artificial Sequence
  Synthetic Polynucleotide
cgtcaacccc

SEQ ID NO: 2895 - DNA, 10 bp, Artificial Sequence
  Synthetic Polynucleotide
cggtgcatac

SEQ ID NO: 2896 - DNA, 10 bp, Artificial Sequence
  Synthetic Polynucleotide
accagctcca

SEQ ID NO: 2897 - DNA, 10 bp, Artificial Sequence
  Synthetic Polynucleotide
ccggttgata

SEQ ID NO: 2898 - DNA, 10 bp, Artificial Sequence
  Synthetic Polynucleotide
gccaagactc

SEQ ID NO: 2899 - DNA, 10 bp, Artificial Sequence
  Synthetic Polynucleotide
aagcacgggt

SEQ ID NO: 2900 - DNA, 10 bp, Artificial Sequence
  Synthetic Polynucleotide
gtgccagcat

SEQ ID NO: 2901 - DNA, 10 bp, Artificial Sequence
  Synthetic Polynucleotide
agtagcgtgt

SEQ ID NO: 2902 - DNA, 10 bp, Artificial Sequence
  Synthetic Polynucleotide
ggcgttccaa

SEQ ID NO: 2903 - DNA, 10 bp, Artificial Sequence
  Synthetic Polynucleotide
aggtggttgc

SEQ ID NO: 2904 - DNA, 10 bp, Artificial Sequence
  Synthetic Polynucleotide
agcccaatgc

SEQ ID NO: 2905 - DNA, 10 bp, Artificial Sequence
  Synthetic Polynucleotide
atgagtggga

SEQ ID NO: 2906 - DNA, 10 bp, Artificial Sequence
  Synthetic Polynucleotide
tcgttgcttg

SEQ ID NO: 2907 - DNA, 10 bp, Artificial Sequence
  Synthetic Polynucleotide
gcgacgaaaa

SEQ ID NO: 2908 - DNA, 10 bp, Artificial Sequence
  Synthetic Polynucleotide
tgccgtcttt

SEQ ID NO: 2909 - DNA, 10 bp, Artificial Sequence
  Synthetic Polynucleotide
aacgccacca

SEQ ID NO: 2910 - DNA, 10 bp, Artificial Sequence
  Synthetic Polynucleotide
ccttgccgtc

SEQ ID NO: 2911 - DNA, 10 bp, Artificial Sequence
  Synthetic Polynucleotide
ccaccgacga

SEQ ID NO: 2912 - DNA, 10 bp, Artificial Sequence
  Synthetic Polynucleotide
ccgtcctcca

SEQ ID NO: 2913 - DNA, 10 bp, Artificial Sequence
  Synthetic Polynucleotide
aaaaccgcag

SEQ ID NO: 2914 - DNA, 10 bp, Artificial Sequence
  Synthetic Polynucleotide
gtcctcgaac

SEQ ID NO: 2915 - DNA, 10 bp, Artificial Sequence
  Synthetic Polynucleotide
gaaggtgctg

SEQ ID NO: 2916 - DNA, 10 bp, Artificial Sequence
  Synthetic Polynucleotide
cagcagcagc

SEQ ID NO: 2917 - DNA, 10 bp, Artificial Sequence
  Synthetic Polynucleotide
gacgacgacg

SEQ ID NO: 2918 - DNA, 10 bp, Artificial Sequence
  Synthetic Polynucleotide
acaatcgcta

SEQ ID NO: 2919 - DNA, 10 bp, Artificial Sequence
  Synthetic Polynucleotide
cacgaaagga

SEQ ID NO: 2920 - DNA, 10 bp, Artificial Sequence
  Synthetic Polynucleotide
gccgttgccg

SEQ ID NO: 2921 - DNA, 10 bp, Artificial Sequence
  Synthetic Polynucleotide
cgaccccgac

SEQ ID NO: 2922 - DNA, 10 bp, Artificial Sequence
  Synthetic Polynucleotide
catttcgcca

SEQ ID NO: 2923 - DNA, 10 bp, Artificial Sequence
  Synthetic Polynucleotide
tgaagaagcg

SEQ ID NO: 2924 - DNA, 10 bp, Artificial Sequence
  Synthetic Polynucleotide
gccgccgttg

SEQ ID NO: 2925 - DNA, 10 bp, Artificial Sequence
  Synthetic Polynucleotide
ccctcgccat

SEQ ID NO: 2926 - DNA, 10 bp, Artificial Sequence
  Synthetic Polynucleotide
caccaccaga

SEQ ID NO: 2927 - DNA, 10 bp, Artificial Sequence
  Synthetic Polynucleotide
atgccagcaa

SEQ ID NO: 2928 - DNA, 10 bp, Artificial Sequence
  Synthetic Polynucleotide
ctggtcggcg

SEQ ID NO: 2929 - DNA, 10 bp, Artificial Sequence
  Synthetic Polynucleotide
gatcgaggca

SEQ ID NO: 2930 - DNA, 10 bp, Artificial Sequence
  Synthetic Polynucleotide
gctcgtcagc

SEQ ID NO: 2931 - DNA, 10 bp, Artificial Sequence
  Synthetic Polynucleotide
gcggctcgct

SEQ ID NO: 2932 - DNA, 10 bp, Artificial Sequence
  Synthetic Polynucleotide
cgccattcgt

SEQ ID NO: 2933 - DNA, 10 bp, Artificial Sequence
  Synthetic Polynucleotide
aaagacgctg

SEQ ID NO: 2934 - DNA, 10 bp, Artificial Sequence
  Synthetic Polynucleotide
gtttcggcat

SEQ ID NO: 2935 - DNA, 10 bp, Artificial Sequence
  Synthetic Polynucleotide
aacgcaaaga

SEQ ID NO: 2936 - DNA, 10 bp, Artificial Sequence
  Synthetic Polynucleotide
aagccactga

SEQ ID NO: 2937 - DNA, 10 bp, Artificial Sequence
  Synthetic Polynucleotide
ggtgaaggtg

SEQ ID NO: 2938 - DNA, 10 bp, Artificial Sequence
  Synthetic Polynucleotide
ttcctgccat

SEQ ID NO: 2939 - DNA, 10 bp, Artificial Sequence
  Synthetic Polynucleotide
aagacggcaa

SEQ ID NO: 2940 - DNA, 10 bp, Artificial Sequence
  Synthetic Polynucleotide
cgcttcttca

SEQ ID NO: 2941 - DNA, 10 bp, Artificial Sequence
  Synthetic Polynucleotide
acgccctaaa

SEQ ID NO: 2942 - DNA, 10 bp, Artificial Sequence
  Synthetic Polynucleotide
caccaccgcc

SEQ ID NO: 2943 - DNA, 10 bp, Artificial Sequence
  Synthetic Polynucleotide
ggcaacggtg

SEQ ID NO: 2944 - DNA, 10 bp, Artificial Sequence
  Synthetic Polynucleotide
atcgtcgagt

SEQ ID NO: 2945 - DNA, 10 bp, Artificial Sequence
  Synthetic Polynucleotide
caggcccagc

SEQ ID NO: 2946 - DNA, 10 bp, Artificial Sequence
  Synthetic Polynucleotide
gcgccccagt

SEQ ID NO: 2947 - DNA, 10 bp, Artificial Sequence
  Synthetic Polynucleotide
ggggcgtttt

SEQ ID NO: 2948 - DNA, 10 bp, Artificial Sequence
  Synthetic Polynucleotide
tcaatgcgtt

SEQ ID NO: 2949 - DNA, 10 bp, Artificial Sequence
  Synthetic Polynucleotide
cgaaagcagc

SEQ ID NO: 2950 - DNA, 10 bp, Artificial Sequence
  Synthetic Polynucleotide
cgccagcagg

SEQ ID NO: 2951 - DNA, 10 bp, Artificial Sequence
  Synthetic Polynucleotide
acaagaccga

SEQ ID NO: 2952 - DNA, 10 bp, Artificial Sequence
  Synthetic Polynucleotide
tcaagctgtc

SEQ ID NO: 2953 - DNA, 10 bp, Artificial Sequence
  Synthetic Polynucleotide
gcagacgaac

SEQ ID NO: 2954 - DNA, 10 bp, Artificial Sequence
  Synthetic Polynucleotide
catcgttgcc

SEQ ID NO: 2955 - DNA, 10 bp, Artificial Sequence
  Synthetic Polynucleotide
accacaacca

SEQ ID NO: 2956 - DNA, 10 bp, Artificial Sequence
  Synthetic Polynucleotide
tcctgttcct

SEQ ID NO: 2957 - DNA, 10 bp, Artificial Sequence
  Synthetic Polynucleotide
aaaggagcga

SEQ ID NO: 2958 - DNA, 10 bp, Artificial Sequence
  Synthetic Polynucleotide
gcaaggcaat

SEQ ID NO: 2959 - DNA, 10 bp, Artificial Sequence
  Synthetic Polynucleotide
cgccaaactg

SEQ ID NO: 2960 - DNA, 10 bp, Artificial Sequence
  Synthetic Polynucleotide
cagttgcaga

SEQ ID NO: 2961 - DNA, 10 bp, Artificial Sequence
  Synthetic Polynucleotide
gtccaaccgc

SEQ ID NO: 2962 - DNA, 10 bp, Artificial Sequence
  Synthetic Polynucleotide
catggcacaa

SEQ ID NO: 2963 - DNA, 10 bp, Artificial Sequence
  Synthetic Polynucleotide
tgcttcgagt

SEQ ID NO: 2964 - DNA, 10 bp, Artificial Sequence
  Synthetic Polynucleotide
gctcaaagcc

SEQ ID NO: 2965 - DNA, 10 bp, Artificial Sequence
  Synthetic Polynucleotide
accgtaccat

SEQ ID NO: 2966 - DNA, 10 bp, Artificial Sequence
  Synthetic Polynucleotide
tggctctgat

SEQ ID NO: 2967 - DNA, 10 bp, Artificial Sequence
  Synthetic Polynucleotide
aaagctcgtg

SEQ ID NO: 2968 - DNA, 10 bp, Artificial Sequence
  Synthetic Polynucleotide
tgtacctgct

SEQ ID NO: 2969 - DNA, 10 bp, Artificial Sequence
  Synthetic Polynucleotide
actctcgctt

SEQ ID NO: 2970 - DNA, 10 bp, Artificial Sequence
  Synthetic Polynucleotide
aacgcaaaga

SEQ ID NO: 2971 - DNA, 10 bp, Artificial Sequence
  Synthetic Polynucleotide
atctccgcca

SEQ ID NO: 2972 - DNA, 10 bp, Artificial Sequence
  Synthetic Polynucleotide
gctaaggctg

SEQ ID NO: 2973 - DNA, 10 bp, Artificial Sequence
  Synthetic Polynucleotide
ccctttcgta

SEQ ID NO: 2974 - DNA, 10 bp, Artificial Sequence
  Synthetic Polynucleotide
ttgttgtgca

SEQ ID NO: 2975 - DNA, 10 bp, Artificial Sequence
  Synthetic Polynucleotide
ctttgcaggt

SEQ ID NO: 2976 - DNA, 10 bp, Artificial Sequence
  Synthetic Polynucleotide
aagtggtgga

SEQ ID NO: 2977 - DNA, 10 bp, Artificial Sequence
  Synthetic Polynucleotide
ggcttcgggg

SEQ ID NO: 2978 - DNA, 10 bp, Artificial Sequence
  Synthetic Polynucleotide
acgcaggagg

SEQ ID NO: 2979 - DNA, 10 bp, Artificial Sequence
  Synthetic Polynucleotide
gcatgttggc

SEQ ID NO: 2980 - DNA, 10 bp, Artificial Sequence
  Synthetic Polynucleotide
tccgcatccg

SEQ ID NO: 2981 - DNA, 10 bp, Artificial Sequence
  Synthetic Polynucleotide
cacgcagtta

SEQ ID NO: 2982 - DNA, 10 bp, Artificial Sequence
  Synthetic Polynucleotide
cagccagccg

SEQ ID NO: 2983 - DNA, 10 bp, Artificial Sequence
  Synthetic Polynucleotide
tcttgtgggc

SEQ ID NO: 2984 - DNA, 10 bp, Artificial Sequence
  Synthetic Polynucleotide
ggcactccgc

SEQ ID NO: 2985 - DNA, 10 bp, Artificial Sequence
  Synthetic Polynucleotide
ttgagcccaa

SEQ ID NO: 2986 - DNA, 10 bp, Artificial Sequence
  Synthetic Polynucleotide
ggggagaggg

SEQ ID NO: 2987 - DNA, 10 bp, Artificial Sequence
  Synthetic Polynucleotide
aaagcagccg

SEQ ID NO: 2988 - DNA, 10 bp, Artificial Sequence
  Synthetic Polynucleotide
ctgtccacca

SEQ ID NO: 2989 - DNA, 10 bp, Artificial Sequence
  Synthetic Polynucleotide
cgttgcagtt

SEQ ID NO: 2990 - DNA, 10 bp, Artificial Sequence
  Synthetic Polynucleotide
tacccgaaac

SEQ ID NO: 2991 - DNA, 10 bp, Artificial Sequence
  Synthetic Polynucleotide
gggttttcgt

SEQ ID NO: 2992 - DNA, 10 bp, Artificial Sequence
  Synthetic Polynucleotide
actgccaaga

SEQ ID NO: 2993 - DNA, 10 bp, Artificial Sequence
  Synthetic Polynucleotide
tggtgccagt

SEQ ID NO: 2994 - DNA, 10 bp, Artificial Sequence
  Synthetic Polynucleotide
caccaccacc

SEQ ID NO: 2995 - DNA, 10 bp, Artificial Sequence
  Synthetic Polynucleotide
cgttgtcgtc

SEQ ID NO: 2996 - DNA, 10 bp, Artificial Sequence
  Synthetic Polynucleotide
gaaacggaca

SEQ ID NO: 2997 - DNA, 10 bp, Artificial Sequence
  Synthetic Polynucleotide
tgtcccagtg

SEQ ID NO: 2998 - DNA, 10 bp, Artificial Sequence
  Synthetic Polynucleotide
tcatgacagc

SEQ ID NO: 2999 - DNA, 10 bp, Artificial Sequence
  Synthetic Polynucleotide
agtgttcggc

SEQ ID NO: 3000 - DNA, 10 bp, Artificial Sequence
  Synthetic Polynucleotide
cgcgacgtta

SEQ ID NO: 3001 - DNA, 10 bp, Artificial Sequence
  Synthetic Polynucleotide
tgcagttcct

SEQ ID NO: 3002 - DNA, 10 bp, Artificial Sequence
  Synthetic Polynucleotide
agcaggtacc

SEQ ID NO: 3003 - DNA, 10 bp, Artificial Sequence
  Synthetic Polynucleotide
gtcgttcggc

SEQ ID NO: 3004 - DNA, 10 bp, Artificial Sequence
  Synthetic Polynucleotide
cttgttccgc

SEQ ID NO: 3005 - DNA, 10 bp, Artificial Sequence
  Synthetic Polynucleotide
gggaggtcct

SEQ ID NO: 3006 - DNA, 10 bp, Artificial Sequence
  Synthetic Polynucleotide
tagggaggcc

SEQ ID NO: 3007 - DNA, 10 bp, Artificial Sequence
  Synthetic Polynucleotide
tcttctccgc

SEQ ID NO: 3008 - DNA, 10 bp, Artificial Sequence
  Synthetic Polynucleotide
aggggtgcct

SEQ ID NO: 3009 - DNA, 10 bp, Artificial Sequence
  Synthetic Polynucleotide
cgctgtttct

SEQ ID NO: 3010 - DNA, 10 bp, Artificial Sequence
  Synthetic Polynucleotide
tactcacgac

SEQ ID NO: 3011 - DNA, 10 bp, Artificial Sequence
  Synthetic Polynucleotide
tctggggagg

SEQ ID NO: 3012 - DNA, 10 bp, Artificial Sequence
  Synthetic Polynucleotide
tctccgcctt

SEQ ID NO: 3013 - DNA, 10 bp, Artificial Sequence
  Synthetic Polynucleotide
caggaagcgc

SEQ ID NO: 3014 - DNA, 10 bp, Artificial Sequence
  Synthetic Polynucleotide
gttgctgggg

SEQ ID NO: 3015 - DNA, 10 bp, Artificial Sequence
  Synthetic Polynucleotide
cgcgtgtcac

SEQ ID NO: 3016 - DNA, 10 bp, Artificial Sequence
  Synthetic Polynucleotide
tccgggatgc

SEQ ID NO: 3017 - DNA, 10 bp, Artificial Sequence
  Synthetic Polynucleotide
caccacacca

SEQ ID NO: 3018 - DNA, 10 bp, Artificial Sequence
  Synthetic Polynucleotide
gcgatacctc

SEQ ID NO: 3019 - DNA, 10 bp, Artificial Sequence
  Synthetic Polynucleotide
gcaggatgga

SEQ ID NO: 3020 - DNA, 10 bp, Artificial Sequence
  Synthetic Polynucleotide
gaaacgtgct

SEQ ID NO: 3021 - DNA, 10 bp, Artificial Sequence
  Synthetic Polynucleotide
aagggcagga

SEQ ID NO: 3022 - DNA, 10 bp, Artificial Sequence
  Synthetic Polynucleotide
ccaccattgg

SEQ ID NO: 3023 - DNA, 10 bp, Artificial Sequence
  Synthetic Polynucleotide
ccttggctgt

SEQ ID NO: 3024 - DNA, 10 bp, Artificial Sequence
  Synthetic Polynucleotide
agcgaactgt

SEQ ID NO: 3025 - DNA, 10 bp, Artificial Sequence
  Synthetic Polynucleotide
tccttctgga

SEQ ID NO: 3026 - DNA, 10 bp, Artificial Sequence
  Synthetic Polynucleotide
gccaaaccgt

SEQ ID NO: 3027 - DNA, 10 bp, Artificial Sequence
  Synthetic Polynucleotide
atccaaccca

SEQ ID NO: 3028 - DNA, 10 bp, Artificial Sequence
  Synthetic Polynucleotide
cgattgtgga

SEQ ID NO: 3029 - DNA, 10 bp, Artificial Sequence
  Synthetic Polynucleotide
cccgacccgg

SEQ ID NO: 3030 - DNA, 10 bp, Artificial Sequence
  Synthetic Polynucleotide
ttgcgttcca

SEQ ID NO: 3031 - DNA, 10 bp, Artificial Sequence
  Synthetic Polynucleotide
ggagatggcg

SEQ ID NO: 3032 - DNA, 10 bp, Artificial Sequence
  Synthetic Polynucleotide
cccaggggat

SEQ ID NO: 3033 - DNA, 10 bp, Artificial Sequence
  Synthetic Polynucleotide
gactctgggg

SEQ ID NO: 3034 - DNA, 10 bp, Artificial Sequence
  Synthetic Polynucleotide
atttgccgtg

SEQ ID NO: 3035 - DNA, 10 bp, Artificial Sequence
  Synthetic Polynucleotide
tcaactcgtc

SEQ ID NO: 3036 - DNA, 10 bp, Artificial Sequence
  Synthetic Polynucleotide
tggagaaccg

SEQ ID NO: 3037 - DNA, 10 bp, Artificial Sequence
  Synthetic Polynucleotide
cacgagcacg

SEQ ID NO: 3038 - DNA, 10 bp, Artificial Sequence
  Synthetic Polynucleotide
cgggtcgtct

SEQ ID NO: 3039 - DNA, 10 bp, Artificial Sequence
  Synthetic Polynucleotide
tcgctctaca

SEQ ID NO: 3040 - DNA, 10 bp, Artificial Sequence
  Synthetic Polynucleotide
tggaggcggg

SEQ ID NO: 3041 - DNA, 10 bp, Artificial Sequence
  Synthetic Polynucleotide
ttcaccgacg

SEQ ID NO: 3042 - DNA, 10 bp, Artificial Sequence
  Synthetic Polynucleotide
gtaggcgttg

SEQ ID NO: 3043 - DNA, 10 bp, Artificial Sequence
  Synthetic Polynucleotide
cgggattccg

SEQ ID NO: 3044 - DNA, 10 bp, Artificial Sequence
  Synthetic Polynucleotide
atcgctggca

SEQ ID NO: 3045 - DNA, 10 bp, Artificial Sequence
  Synthetic Polynucleotide
cagccaatga

SEQ ID NO: 3046 - DNA, 10 bp, Artificial Sequence
  Synthetic Polynucleotide
agaccgttgg

SEQ ID NO: 3047 - DNA, 10 bp, Artificial Sequence
  Synthetic Polynucleotide
gcggccttga

SEQ ID NO: 3048 - DNA, 10 bp, Artificial Sequence
  Synthetic Polynucleotide
gtagtggcgt

SEQ ID NO: 3049 - DNA, 10 bp, Artificial Sequence
  Synthetic Polynucleotide
gtcactggcg

SEQ ID NO: 3050 - DNA, 10 bp, Artificial Sequence
  Synthetic Polynucleotide
gctgcatcga

SEQ ID NO: 3051 - DNA, 10 bp, Artificial Sequence
  Synthetic Polynucleotide
caacacacca

SEQ ID NO: 3052 - DNA, 10 bp, Artificial Sequence
  Synthetic Polynucleotide
ctctgcttcg

SEQ ID NO: 3053 - DNA, 10 bp, Artificial Sequence
  Synthetic Polynucleotide
gtggaagggg

SEQ ID NO: 3054 - DNA, 10 bp, Artificial Sequence
  Synthetic Polynucleotide
ggtcgtacca

SEQ ID NO: 3055 - DNA, 10 bp, Artificial Sequence
  Synthetic Polynucleotide
aaggtgggca

SEQ ID NO: 3056 - DNA, 10 bp, Artificial Sequence
  Synthetic Polynucleotide
tctgtttgca

SEQ ID NO: 3057 - DNA, 10 bp, Artificial Sequence
  Synthetic Polynucleotide
atacgaccca

SEQ ID NO: 3058 - DNA, 10 bp, Artificial Sequence
  Synthetic Polynucleotide
actgtggccc

SEQ ID NO: 3059 - DNA, 10 bp, Artificial Sequence
  Synthetic Polynucleotide
cgaggaccgg

SEQ ID NO: 3060 - DNA, 10 bp, Artificial Sequence
  Synthetic Polynucleotide
ttggacccta

SEQ ID NO: 3061 - DNA, 10 bp, Artificial Sequence
  Synthetic Polynucleotide
tcgtcaacgt

SEQ ID NO: 3062 - DNA, 10 bp, Artificial Sequence
  Synthetic Polynucleotide
ccacattccc

SEQ ID NO: 3063 - DNA, 10 bp, Artificial Sequence
  Synthetic Polynucleotide
atccagagca

SEQ ID NO: 3064 - DNA, 10 bp, Artificial Sequence
  Synthetic Polynucleotide
tcttgacggg

SEQ ID NO: 3065 - DNA, 10 bp, Artificial Sequence
  Synthetic Polynucleotide
cagactggcg

SEQ ID NO: 3066 - DNA, 10 bp, Artificial Sequence
  Synthetic Polynucleotide
gcgaaaaggg

SEQ ID NO: 3067 - DNA, 10 bp, Artificial Sequence
  Synthetic Polynucleotide
gacgacaaca

SEQ ID NO: 3068 - DNA, 10 bp, Artificial Sequence
  Synthetic Polynucleotide
gagagctggg

SEQ ID NO: 3069 - DNA, 10 bp, Artificial Sequence
  Synthetic Polynucleotide
cttcctcccc

SEQ ID NO: 3070 - DNA, 10 bp, Artificial Sequence
  Synthetic Polynucleotide
tgaagaggga

SEQ ID NO: 3071 - DNA, 10 bp, Artificial Sequence
  Synthetic Polynucleotide
ctccctccaa

SEQ ID NO: 3072 - DNA, 10 bp, Artificial Sequence
  Synthetic Polynucleotide
gtgtggcgat

SEQ ID NO: 3073 - DNA, 10 bp, Artificial Sequence
  Synthetic Polynucleotide
gcccaacaac

SEQ ID NO: 3074 - DNA, 10 bp, Artificial Sequence
  Synthetic Polynucleotide
gaaactgaca

SEQ ID NO: 3075 - DNA, 10 bp, Artificial Sequence
  Synthetic Polynucleotide
ttttgatgcg

SEQ ID NO: 3076 - DNA, 10 bp, Artificial Sequence
  Synthetic Polynucleotide
actcaagagt

SEQ ID NO: 3077 - DNA, 10 bp, Artificial Sequence
  Synthetic Polynucleotide
catcatcaat

SEQ ID NO: 3078 - DNA, 10 bp, Artificial Sequence
  Synthetic Polynucleotide
tgttttcatg

SEQ ID NO: 3079 - DNA, 10 bp, Artificial Sequence
  Synthetic Polynucleotide
attgaaacac

SEQ ID NO: 3080 - DNA, 10 bp, Artificial Sequence
  Synthetic Polynucleotide
gccagttagc

SEQ ID NO: 3081 - DNA, 10 bp, Artificial Sequence
  Synthetic Polynucleotide
aaggactggt

SEQ ID NO: 3082 - DNA, 10 bp, Artificial Sequence
  Synthetic Polynucleotide
ttccaaattt

SEQ ID NO: 3083 - DNA, 10 bp, Artificial Sequence
  Synthetic Polynucleotide
gattccaaat

SEQ ID NO: 3084 - DNA, 10 bp, Artificial Sequence
  Synthetic Polynucleotide
accaggaacc

SEQ ID NO: 3085 - DNA, 10 bp, Artificial Sequence
  Synthetic Polynucleotide
tagaaaggac

SEQ ID NO: 3086 - DNA, 10 bp, Artificial Sequence
  Synthetic Polynucleotide
ggggtaatac

SEQ ID NO: 3087 - DNA, 10 bp, Artificial Sequence
  Synthetic Polynucleotide
tatacccatt

SEQ ID NO: 3088 - DNA, 10 bp, Artificial Sequence
  Synthetic Polynucleotide
acagtggatc

SEQ ID NO: 3089 - DNA, 10 bp, Artificial Sequence
  Synthetic Polynucleotide
ccaaactgat

SEQ ID NO: 3090 - DNA, 10 bp, Artificial Sequence
  Synthetic Polynucleotide
aaccagcagc

SEQ ID NO: 3091 - DNA, 10 bp, Artificial Sequence
  Synthetic Polynucleotide
ggatcctagg

SEQ ID NO: 3092 - DNA, 10 bp, Artificial Sequence
  Synthetic Polynucleotide
ccaaattgat

SEQ ID NO: 3093 - DNA, 10 bp, Artificial Sequence
  Synthetic Polynucleotide
aacccttatg

SEQ ID NO: 3094 - DNA, 10 bp, Artificial Sequence
  Synthetic Polynucleotide
cttcaatgtc

SEQ ID NO: 3095 - DNA, 10 bp, Artificial Sequence
  Synthetic Polynucleotide
caaaccaaca

SEQ ID NO: 3096 - DNA, 10 bp, Artificial Sequence
  Synthetic Polynucleotide
atgatgttgt

SEQ ID NO: 3097 - DNA, 10 bp, Artificial Sequence
  Synthetic Polynucleotide
tttcatatgg

SEQ ID NO: 3098 - DNA, 10 bp, Artificial Sequence
  Synthetic Polynucleotide
gtgatgatca

SEQ ID NO: 3099 - DNA, 10 bp, Artificial Sequence
  Synthetic Polynucleotide
atctagattt

SEQ ID NO: 3100 - DNA, 10 bp, Artificial Sequence
  Synthetic Polynucleotide
ccaggtggat

SEQ ID NO: 3101 - DNA, 10 bp, Artificial Sequence
  Synthetic Polynucleotide
cacaaaactc

SEQ ID NO: 3102 - DNA, 10 bp, Artificial Sequence
  Synthetic Polynucleotide
ttgtaatcaa

SEQ ID NO: 3103 - DNA, 10 bp, Artificial Sequence
  Synthetic Polynucleotide
tctgatgcac

SEQ ID NO: 3104 - DNA, 10 bp, Artificial Sequence
  Synthetic Polynucleotide
aacaagatgc

SEQ ID NO: 3105 - DNA, 10 bp, Artificial Sequence
  Synthetic Polynucleotide
ccgtgaccca

SEQ ID NO: 3106 - DNA, 10 bp, Artificial Sequence
  Synthetic Polynucleotide
agtcctcttt

SEQ ID NO: 3107 - DNA, 10 bp, Artificial Sequence
  Synthetic Polynucleotide
ggtggactca

SEQ ID NO: 3108 - DNA, 10 bp, Artificial Sequence
  Synthetic Polynucleotide
aaaccagcaa

SEQ ID NO: 3109 - DNA, 10 bp, Artificial Sequence
  Synthetic Polynucleotide
tctccaaacc

SEQ ID NO: 3110 - DNA, 10 bp, Artificial Sequence
  Synthetic Polynucleotide
cttgacccgc

SEQ ID NO: 3111 - DNA, 10 bp, Artificial Sequence
  Synthetic Polynucleotide
agtcatcatc

SEQ ID NO: 3112 - DNA, 10 bp, Artificial Sequence
  Synthetic Polynucleotide
cagttgttgt

SEQ ID NO: 3113 - DNA, 10 bp, Artificial Sequence
  Synthetic Polynucleotide
ggcctgtgtg

SEQ ID NO: 3114 - DNA, 10 bp, Artificial Sequence
  Synthetic Polynucleotide
tgtgcctcaa

SEQ ID NO: 3115 - DNA, 10 bp, Artificial Sequence
  Synthetic Polynucleotide
gaagaagaag

SEQ ID NO: 3116 - DNA, 10 bp, Artificial Sequence
  Synthetic Polynucleotide
ggtgaacaaa

SEQ ID NO: 3117 - DNA, 10 bp, Artificial Sequence
  Synthetic Polynucleotide
caacttcatg

SEQ ID NO: 3118 - DNA, 10 bp, Artificial Sequence
  Synthetic Polynucleotide
acacaaagta

SEQ ID NO: 3119 - DNA, 10 bp, Artificial Sequence
  Synthetic Polynucleotide
tttgtagttt

SEQ ID NO: 3120 - DNA, 10 bp, Artificial Sequence
  Synthetic Polynucleotide
aagatgatga

SEQ ID NO: 3121 - DNA, 10 bp, Artificial Sequence
  Synthetic Polynucleotide
aggaagttgt

SEQ ID NO: 3122 - DNA, 10 bp, Artificial Sequence
  Synthetic Polynucleotide
agcgtggtag

SEQ ID NO: 3123 - DNA, 10 bp, Artificial Sequence
  Synthetic Polynucleotide
cccctccaaa

SEQ ID NO: 3124 - DNA, 10 bp, Artificial Sequence
  Synthetic Polynucleotide
ttttggcatg

SEQ ID NO: 3125 - DNA, 10 bp, Artificial Sequence
  Synthetic Polynucleotide
aataaaatta

SEQ ID NO: 3126 - DNA, 10 bp, Artificial Sequence
  Synthetic Polynucleotide
tgttgttgtt

SEQ ID NO: 3127 - DNA, 10 bp, Artificial Sequence
  Synthetic Polynucleotide
aaataaattt

SEQ ID NO: 3128 - DNA, 10 bp, Artificial Sequence
  Synthetic Polynucleotide
aataaatttt

SEQ ID NO: 3129 - DNA, 10 bp, Artificial Sequence
  Synthetic Polynucleotide
ttttctaaaa

SEQ ID NO: 3130 - DNA, 10 bp, Artificial Sequence
  Synthetic Polynucleotide
ttgttttatt

SEQ ID NO: 3131 - DNA, 10 bp, Artificial Sequence
  Synthetic Polynucleotide
tgacggacgt

SEQ ID NO: 3132 - DNA, 10 bp, Artificial Sequence
  Synthetic Polynucleotide
ttgttgttca

SEQ ID NO: 3133 - DNA, 10 bp, Artificial Sequence
  Synthetic Polynucleotide
aaaataaata

SEQ ID NO: 3134 - DNA, 10 bp, Artificial Sequence
  Synthetic Polynucleotide
caccgacaac

SEQ ID NO: 3135 - DNA, 10 bp, Artificial Sequence
  Synthetic Polynucleotide
atcttcctca

SEQ ID NO: 3136 - DNA, 10 bp, Artificial Sequence
  Synthetic Polynucleotide
gtcctggttt

SEQ ID NO: 3137 - DNA, 10 bp, Artificial Sequence
  Synthetic Polynucleotide
gtgatttggc

SEQ ID NO: 3138 - DNA, 10 bp, Artificial Sequence
  Synthetic Polynucleotide
tatacccatt

SEQ ID NO: 3139 - DNA, 10 bp, Artificial Sequence
  Synthetic Polynucleotide
ggttttgcct

SEQ ID NO: 3140 - DNA, 10 bp, Artificial Sequence
  Synthetic Polynucleotide
gcgtcccaga

SEQ ID NO: 3141 - DNA, 10 bp, Artificial Sequence
  Synthetic Polynucleotide
gcagcctgtg

SEQ ID NO: 3142 - DNA, 10 bp, Artificial Sequence
  Synthetic Polynucleotide
gatgtcatgg

SEQ ID NO: 3143 - DNA, 10 bp, Artificial Sequence
  Synthetic Polynucleotide
tgtcagcata

SEQ ID NO: 3144 - DNA, 10 bp, Artificial Sequence
  Synthetic Polynucleotide
gactactggt

SEQ ID NO: 3145 - DNA, 10 bp, Artificial Sequence
  Synthetic Polynucleotide
ttgatgccaa

SEQ ID NO: 3146 - DNA, 10 bp, Artificial Sequence
  Synthetic Polynucleotide
gcggtatgcc

SEQ ID NO: 3147 - DNA, 10 bp, Artificial Sequence
  Synthetic Polynucleotide
gtagcagggt

SEQ ID NO: 3148 - DNA, 10 bp, Artificial Sequence
  Synthetic Polynucleotide
agggaacatg

SEQ ID NO: 3149 - DNA, 10 bp, Artificial Sequence
  Synthetic Polynucleotide
ttattcctgc

SEQ ID NO: 3150 - DNA, 10 bp, Artificial Sequence
  Synthetic Polynucleotide
gagacagacc

SEQ ID NO: 3151 - DNA, 10 bp, Artificial Sequence
  Synthetic Polynucleotide
taggcatcta

SEQ ID NO: 3152 - DNA, 10 bp, Artificial Sequence
  Synthetic Polynucleotide
gtgctcagca

SEQ ID NO: 3153 - DNA, 10 bp, Artificial Sequence
  Synthetic Polynucleotide
tggtctcctt

SEQ ID NO: 3154 - DNA, 10 bp, Artificial Sequence
  Synthetic Polynucleotide
tcttcggaag

SEQ ID NO: 3155 - DNA, 10 bp, Artificial Sequence
  Synthetic Polynucleotide
ggtctctctt

SEQ ID NO: 3156 - DNA, 10 bp, Artificial Sequence
  Synthetic Polynucleotide
tttctataaa

SEQ ID NO: 3157 - DNA, 10 bp, Artificial Sequence
  Synthetic Polynucleotide
ctcctatgga

SEQ ID NO: 3158 - DNA, 10 bp, Artificial Sequence
  Synthetic Polynucleotide
ttcttacaag

SEQ ID NO: 3159 - DNA, 10 bp, Artificial Sequence
  Synthetic Polynucleotide
gcaagcccat

SEQ ID NO: 3160 - DNA, 10 bp, Artificial Sequence
  Synthetic Polynucleotide
ggttgacacg

SEQ ID NO: 3161 - DNA, 10 bp, Artificial Sequence
  Synthetic Polynucleotide
ctaatcgggg

SEQ ID NO: 3162 - DNA, 10 bp, Artificial Sequence
  Synthetic Polynucleotide
gagatggacc

SEQ ID NO: 3163 - DNA, 10 bp, Artificial Sequence
  Synthetic Polynucleotide
gataataatc

SEQ ID NO: 3164 - DNA, 10 bp, Artificial Sequence
  Synthetic Polynucleotide
aaatttccac

SEQ ID NO: 3165 - DNA, 10 bp, Artificial Sequence
  Synthetic Polynucleotide
tcatcagtgt

SEQ ID NO: 3166 - DNA, 10 bp, Artificial Sequence
  Synthetic Polynucleotide
tcgatgaggt

SEQ ID NO: 3167 - DNA, 10 bp, Artificial Sequence
  Synthetic Polynucleotide
cttcacgcaa

SEQ ID NO: 3168 - DNA, 10 bp, Artificial Sequence
  Synthetic Polynucleotide
atgagattaa

SEQ ID NO: 3169 - DNA, 10 bp, Artificial Sequence
  Synthetic Polynucleotide
gagcatttat

SEQ ID NO: 3170 - DNA, 10 bp, Artificial Sequence
  Synthetic Polynucleotide
acctccactg

SEQ ID NO: 3171 - DNA, 10 bp, Artificial Sequence
  Synthetic Polynucleotide
tatctagcga

SEQ ID NO: 3172 - DNA, 10 bp, Artificial Sequence
  Synthetic Polynucleotide
gtggctcgcc

SEQ ID NO: 3173 - DNA, 10 bp, Artificial Sequence
  Synthetic Polynucleotide
gtatatgacc

SEQ ID NO: 3174 - DNA, 10 bp, Artificial Sequence
  Synthetic Polynucleotide
gatttccaga

SEQ ID NO: 3175 - DNA, 10 bp, Artificial Sequence
  Synthetic Polynucleotide
ctaagggtca

SEQ ID NO: 3176 - DNA, 10 bp, Artificial Sequence
  Synthetic Polynucleotide
tacgatgtcg

SEQ ID NO: 3177 - DNA, 10 bp, Artificial Sequence
  Synthetic Polynucleotide
aggcacgact

SEQ ID NO: 3178 - DNA, 10 bp, Artificial Sequence
  Synthetic Polynucleotide
ggtgatgaac

SEQ ID NO: 3179 - DNA, 10 bp, Artificial Sequence
  Synthetic Polynucleotide
gactatgtgg

SEQ ID NO: 3180 - DNA, 10 bp, Artificial Sequence
  Synthetic Polynucleotide
tatctgtacc

SEQ ID NO: 3181 - DNA, 10 bp, Artificial Sequence
  Synthetic Polynucleotide
tcttcttaaa

SEQ ID NO: 3182 - DNA, 10 bp, Artificial Sequence
  Synthetic Polynucleotide
ggaaagaagg

SEQ ID NO: 3183 - DNA, 10 bp, Artificial Sequence
  Synthetic Polynucleotide
tcttattacc

SEQ ID NO: 3184 - DNA, 10 bp, Artificial Sequence
  Synthetic Polynucleotide
tttctttaaa

SEQ ID NO: 3185 - DNA, 10 bp, Artificial Sequence
  Synthetic Polynucleotide
tccattcagg

SEQ ID NO: 3186 - DNA, 10 bp, Artificial Sequence
  Synthetic Polynucleotide
tttgtcactg

SEQ ID NO: 3187 - DNA, 10 bp, Artificial Sequence
  Synthetic Polynucleotide
acttcggacc

SEQ ID NO: 3188 - DNA, 10 bp, Artificial Sequence
  Synthetic Polynucleotide
actagtgatt

SEQ ID NO: 3189 - DNA, 10 bp, Artificial Sequence
  Synthetic Polynucleotide
atcattaaaa

SEQ ID NO: 3190 - DNA, 10 bp, Artificial Sequence
  Synthetic Polynucleotide
caaaatttcc

SEQ ID NO: 3191 - DNA, 10 bp, Artificial Sequence
  Synthetic Polynucleotide
gatcatcttc

SEQ ID NO: 3192 - DNA, 10 bp, Artificial Sequence
  Synthetic Polynucleotide
aattttgttt

SEQ ID NO: 3193 - DNA, 10 bp, Artificial Sequence
  Synthetic Polynucleotide
gcgcacgagt

SEQ ID NO: 3194 - DNA, 10 bp, Artificial Sequence
  Synthetic Polynucleotide
gaatcgtcgg

SEQ ID NO: 3195 - DNA, 10 bp, Artificial Sequence
  Synthetic Polynucleotide
tcttgatagt

SEQ ID NO: 3196 - DNA, 10 bp, Artificial Sequence
  Synthetic Polynucleotide
agtctattgg

SEQ ID NO: 3197 - DNA, 10 bp, Artificial Sequence
  Synthetic Polynucleotide
atcatcccat

SEQ ID NO: 3198 - DNA, 10 bp, Artificial Sequence
  Synthetic Polynucleotide
ttttcttcct

SEQ ID NO: 3199 - DNA, 10 bp, Artificial Sequence
  Synthetic Polynucleotide
cttctcaatg

SEQ ID NO: 3200 - DNA, 10 bp, Artificial Sequence
  Synthetic Polynucleotide
ctctatgaag

SEQ ID NO: 3201 - DNA, 10 bp, Artificial Sequence
  Synthetic Polynucleotide
gaacaatcgg

SEQ ID NO: 3202 - DNA, 10 bp, Artificial Sequence
  Synthetic Polynucleotide
tgtctcttga

SEQ ID NO: 3203 - DNA, 10 bp, Artificial Sequence
  Synthetic Polynucleotide
aatctgccca

SEQ ID NO: 3204 - DNA, 10 bp, Artificial Sequence
  Synthetic Polynucleotide
gatcaaccat

SEQ ID NO: 3205 - DNA, 10 bp, Artificial Sequence
  Synthetic Polynucleotide
attacgtttg

SEQ ID NO: 3206 - DNA, 10 bp, Artificial Sequence
  Synthetic Polynucleotide
cttaaatcct

SEQ ID NO: 3207 - DNA, 10 bp, Artificial Sequence
  Synthetic Polynucleotide
aaataaactt

SEQ ID NO: 3208 - DNA, 10 bp, Artificial Sequence
  Synthetic Polynucleotide
tctcattgta

SEQ ID NO: 3209 - DNA, 10 bp, Artificial Sequence
  Synthetic Polynucleotide
atgaagagta

SEQ ID NO: 3210 - DNA, 10 bp, Artificial Sequence
  Synthetic Polynucleotide
atactgaaga

SEQ ID NO: 3211 - DNA, 10 bp, Artificial Sequence
  Synthetic Polynucleotide
gagcttcgtg

SEQ ID NO: 3212 - DNA, 10 bp, Artificial Sequence
  Synthetic Polynucleotide
gagttgatga

SEQ ID NO: 3213 - DNA, 10 bp, Artificial Sequence
  Synthetic Polynucleotide
actactcaaa

SEQ ID NO: 3214 - DNA, 10 bp, Artificial Sequence
  Synthetic Polynucleotide
ccatagaagg

SEQ ID NO: 3215 - DNA, 10 bp, Artificial Sequence
  Synthetic Polynucleotide
aacaacatgt

SEQ ID NO: 3216 - DNA, 10 bp, Artificial Sequence
  Synthetic Polynucleotide
tcaaacacta

SEQ ID NO: 3217 - DNA, 10 bp, Artificial Sequence
  Synthetic Polynucleotide
accaggctct

SEQ ID NO: 3218 - DNA, 10 bp, Artificial Sequence
  Synthetic Polynucleotide
acgccatctt

SEQ ID NO: 3219 - DNA, 10 bp, Artificial Sequence
  Synthetic Polynucleotide
tttacgtgcc

SEQ ID NO: 3220 - DNA, 10 bp, Artificial Sequence
  Synthetic Polynucleotide
tgtggtaagt

SEQ ID NO: 3221 - DNA, 10 bp, Artificial Sequence
  Synthetic Polynucleotide
tgatgagtac

SEQ ID NO: 3222 - DNA, 10 bp, Artificial Sequence
  Synthetic Polynucleotide
taatctgcat

SEQ ID NO: 3223 - DNA, 10 bp, Artificial Sequence
  Synthetic Polynucleotide
gattggaatg

SEQ ID NO: 3224 - DNA, 10 bp, Artificial Sequence
  Synthetic Polynucleotide
tcttttggtc

SEQ ID NO: 3225 - DNA, 10 bp, Artificial Sequence
  Synthetic Polynucleotide
aagaaactgg

SEQ ID NO: 3226 - DNA, 10 bp, Artificial Sequence
  Synthetic Polynucleotide
acattcacaa

SEQ ID NO: 3227 - DNA, 10 bp, Artificial Sequence
  Synthetic Polynucleotide
tttggtctgc

SEQ ID NO: 3228 - DNA, 10 bp, Artificial Sequence
  Synthetic Polynucleotide
ttttcagaat

SEQ ID NO: 3229 - DNA, 10 bp, Artificial Sequence
  Synthetic Polynucleotide
gtatcagagc

SEQ ID NO: 3230 - DNA, 10 bp, Artificial Sequence
  Synthetic Polynucleotide
ttcttctttt

SEQ ID NO: 3231 - DNA, 10 bp, Artificial Sequence
  Synthetic Polynucleotide
aagcagaaaa

SEQ ID NO: 3232 - DNA, 10 bp, Artificial Sequence
  Synthetic Polynucleotide
cttcttcatc

SEQ ID NO: 3233 - DNA, 10 bp, Artificial Sequence
  Synthetic Polynucleotide
gaagatgaag

SEQ ID NO: 3234 - DNA, 10 bp, Artificial Sequence
  Synthetic Polynucleotide
acatgcttca

SEQ ID NO: 3235 - DNA, 10 bp, Artificial Sequence
  Synthetic Polynucleotide
cacaggagca

SEQ ID NO: 3236 - DNA, 10 bp, Artificial Sequence
  Synthetic Polynucleotide
cttcttctga

SEQ ID NO: 3237 - DNA, 10 bp, Artificial Sequence
  Synthetic Polynucleotide
aaaagaaaat

SEQ ID NO: 3238 - DNA, 10 bp, Artificial Sequence
  Synthetic Polynucleotide
gatttgcttc

SEQ ID NO: 3239 - DNA, 10 bp, Artificial Sequence
  Synthetic Polynucleotide
ataatgatga

SEQ ID NO: 3240 - DNA, 10 bp, Artificial Sequence
  Synthetic Polynucleotide
aattctattt

SEQ ID NO: 3241 - DNA, 10 bp, Artificial Sequence
  Synthetic Polynucleotide
gaaaataaag

SEQ ID NO: 3242 - DNA, 10 bp, Artificial Sequence
  Synthetic Polynucleotide
tgtagtcagt

SEQ ID NO: 3243 - DNA, 10 bp, Artificial Sequence
  Synthetic Polynucleotide
aaccccatca

SEQ ID NO: 3244 - DNA, 10 bp, Artificial Sequence
  Synthetic Polynucleotide
tggaagtttt

SEQ ID NO: 3245 - DNA, 10 bp, Artificial Sequence
  Synthetic Polynucleotide
atgccttttg

SEQ ID NO: 3246 - DNA, 10 bp, Artificial Sequence
  Synthetic Polynucleotide
acacttaaag

SEQ ID NO: 3247 - DNA, 10 bp, Artificial Sequence
  Synthetic Polynucleotide
tgagcttagg

SEQ ID NO: 3248 - DNA, 10 bp, Artificial Sequence
  Synthetic Polynucleotide
gtttgttgtt

SEQ ID NO: 3249 - DNA, 10 bp, Artificial Sequence
  Synthetic Polynucleotide
cctgaggagg

SEQ ID NO: 3250 - DNA, 10 bp, Artificial Sequence
  Synthetic Polynucleotide
atttctacgc

SEQ ID NO: 3251 - DNA, 10 bp, Artificial Sequence
  Synthetic Polynucleotide
ttgctacacc

SEQ ID NO: 3252 - DNA, 10 bp, Artificial Sequence
  Synthetic Polynucleotide
tcccaccact

SEQ ID NO: 3253 - DNA, 10 bp, Artificial Sequence
  Synthetic Polynucleotide
attggaagac

SEQ ID NO: 3254 - DNA, 10 bp, Artificial Sequence
  Synthetic Polynucleotide
ttgatggggt

SEQ ID NO: 3255 - DNA, 10 bp, Artificial Sequence
  Synthetic Polynucleotide
tttgtggagt

SEQ ID NO: 3256 - DNA, 10 bp, Artificial Sequence
  Synthetic Polynucleotide
cgtgaacttg

SEQ ID NO: 3257 - DNA, 10 bp, Artificial Sequence
  Synthetic Polynucleotide
aaagtgacgt

SEQ ID NO: 3258 - DNA, 10 bp, Artificial Sequence
  Synthetic Polynucleotide
catacaatcc

SEQ ID NO: 3259 - DNA, 10 bp, Artificial Sequence
  Synthetic Polynucleotide
ttgatgactt

SEQ ID NO: 3260 - DNA, 10 bp, Artificial Sequence
  Synthetic Polynucleotide
cacctttcat

SEQ ID NO: 3261 - DNA, 10 bp, Artificial Sequence
  Synthetic Polynucleotide
cgcgagagtt

SEQ ID NO: 3262 - DNA, 10 bp, Artificial Sequence
  Synthetic Polynucleotide
tctccgccca

SEQ ID NO: 3263 - DNA, 10 bp, Artificial Sequence
  Synthetic Polynucleotide
tgtatcgtcg

SEQ ID NO: 3264 - DNA, 10 bp, Artificial Sequence
  Synthetic Polynucleotide
ctcttgccac

SEQ ID NO: 3265 - DNA, 10 bp, Artificial Sequence
  Synthetic Polynucleotide
ggataatgaa

SEQ ID NO: 3266 - DNA, 10 bp, Artificial Sequence
  Synthetic Polynucleotide
tggctcgtag

SEQ ID NO: 3267 - DNA, 10 bp, Artificial Sequence
  Synthetic Polynucleotide
tctatatctc

SEQ ID NO: 3268 - DNA, 10 bp, Artificial Sequence
  Synthetic Polynucleotide
tctatgattt

SEQ ID NO: 3269 - DNA, 10 bp, Artificial Sequence
  Synthetic Polynucleotide
ttcttgaatt

SEQ ID NO: 3270 - DNA, 10 bp, Artificial Sequence
  Synthetic Polynucleotide
tatgactctt

SEQ ID NO: 3271 - DNA, 10 bp, Artificial Sequence
  Synthetic Polynucleotide
tcacaaactg

SEQ ID NO: 3272 - DNA, 10 bp, Artificial Sequence
  Synthetic Polynucleotide
gattttggta

SEQ ID NO: 3273 - DNA, 10 bp, Artificial Sequence
  Synthetic Polynucleotide
tctcaaaacc

SEQ ID NO: 3274 - DNA, 10 bp, Artificial Sequence
  Synthetic Polynucleotide
tcttgtttaa

SEQ ID NO: 3275 - DNA, 10 bp, Artificial Sequence
  Synthetic Polynucleotide
aaccatcttt

SEQ ID NO: 3276 - DNA, 10 bp, Artificial Sequence
  Synthetic Polynucleotide
gaatttattt

SEQ ID NO: 3277 - DNA, 10 bp, Artificial Sequence
  Synthetic Polynucleotide
ttagaacaaa

SEQ ID NO: 3278 - DNA, 10 bp, Artificial Sequence
  Synthetic Polynucleotide
aaatctcaag

SEQ ID NO: 3279 - DNA, 10 bp, Artificial Sequence
  Synthetic Polynucleotide
acattgcctc

SEQ ID NO: 3280 - DNA, 10 bp, Artificial Sequence
  Synthetic Polynucleotide
aagtttcctt

SEQ ID NO: 3281 - DNA, 10 bp, Artificial Sequence
  Synthetic Polynucleotide
ctttggaata

SEQ ID NO: 3282 - DNA, 10 bp, Artificial Sequence
  Synthetic Polynucleotide
catacctcaa

SEQ ID NO: 3283 - DNA, 10 bp, Artificial Sequence
  Synthetic Polynucleotide
tgaaaagttc

SEQ ID NO: 3284 - DNA, 10 bp, Artificial Sequence
  Synthetic Polynucleotide
caatggagag

SEQ ID NO: 3285 - DNA, 10 bp, Artificial Sequence
  Synthetic Polynucleotide
aaaatctttt

SEQ ID NO: 3286 - DNA, 10 bp, Artificial Sequence
  Synthetic Polynucleotide
attttctttt

SEQ ID NO: 3287 - DNA, 10 bp, Artificial Sequence
  Synthetic Polynucleotide
ttttccgggt

SEQ ID NO: 3288 - DNA, 10 bp, Artificial Sequence
  Synthetic Polynucleotide
aaacagcttt

SEQ ID NO: 3289 - DNA, 10 bp, Artificial Sequence
  Synthetic Polynucleotide
catcaccata

SEQ ID NO: 3290 - DNA, 10 bp, Artificial Sequence
  Synthetic Polynucleotide
attgtgatta

SEQ ID NO: 3291 - DNA, 10 bp, Artificial Sequence
  Synthetic Polynucleotide
catcaaatga

SEQ ID NO: 3292 - DNA, 10 bp, Artificial Sequence
  Synthetic Polynucleotide
attacatgga

SEQ ID NO: 3293 - DNA, 10 bp, Artificial Sequence
  Synthetic Polynucleotide
taaacaaata

SEQ ID NO: 3294 - DNA, 10 bp, Artificial Sequence
  Synthetic Polynucleotide
aagaaactca

SEQ ID NO: 3295 - DNA, 10 bp, Artificial Sequence
  Synthetic Polynucleotide
cacactttta

SEQ ID NO: 3296 - DNA, 10 bp, Artificial Sequence
  Synthetic Polynucleotide
actgttaaat

SEQ ID NO: 3297 - DNA, 10 bp, Artificial Sequence
  Synthetic Polynucleotide
tgattcacga

SEQ ID NO: 3298 - DNA, 10 bp, Artificial Sequence
  Synthetic Polynucleotide
caccttaaaa

SEQ ID NO: 3299 - DNA, 10 bp, Artificial Sequence
  Synthetic Polynucleotide
aaagtatacc

SEQ ID NO: 3300 - DNA, 10 bp, Artificial Sequence
  Synthetic Polynucleotide
aattcttgtg

SEQ ID NO: 3301 - DNA, 10 bp, Artificial Sequence
  Synthetic Polynucleotide
tccaagcagc

SEQ ID NO: 3302 - DNA, 10 bp, Artificial Sequence
  Synthetic Polynucleotide
gatattttag

SEQ ID NO: 3303 - DNA, 10 bp, Artificial Sequence
  Synthetic Polynucleotide
cccataagaa

SEQ ID NO: 3304 - DNA, 10 bp, Artificial Sequence
  Synthetic Polynucleotide
tcaagaggaa

SEQ ID NO: 3305 - DNA, 10 bp, Artificial Sequence
  Synthetic Polynucleotide
ttccaaggtg

SEQ ID NO: 3306 - DNA, 10 bp, Artificial Sequence
  Synthetic Polynucleotide
gataaatagc

SEQ ID NO: 3307 - DNA, 10 bp, Artificial Sequence
  Synthetic Polynucleotide
cccaacccat

SEQ ID NO: 3308 - DNA, 10 bp, Artificial Sequence
  Synthetic Polynucleotide
ctcaaatgaa

SEQ ID NO: 3309 - DNA, 10 bp, Artificial Sequence
  Synthetic Polynucleotide
caccaggttt

SEQ ID NO: 3310 - DNA, 10 bp, Artificial Sequence
  Synthetic Polynucleotide
tgaatttgaa

SEQ ID NO: 3311 - DNA, 10 bp, Artificial Sequence
  Synthetic Polynucleotide
gctctatcac

SEQ ID NO: 3312 - DNA, 10 bp, Artificial Sequence
  Synthetic Polynucleotide
ctactatgac

SEQ ID NO: 3313 - DNA, 10 bp, Artificial Sequence
  Synthetic Polynucleotide
aagcaccacc

SEQ ID NO: 3314 - DNA, 10 bp, Artificial Sequence
  Synthetic Polynucleotide
agaataatga

SEQ ID NO: 3315 - DNA, 10 bp, Artificial Sequence
  Synthetic Polynucleotide
atgcaacgtg

SEQ ID NO: 3316 - DNA, 10 bp, Artificial Sequence
  Synthetic Polynucleotide
ttaatacttt

SEQ ID NO: 3317 - DNA, 10 bp, Artificial Sequence
  Synthetic Polynucleotide
gaacggaacg

SEQ ID NO: 3318 - DNA, 10 bp, Artificial Sequence
  Synthetic Polynucleotide
agagcaaaca

SEQ ID NO: 3319 - DNA, 10 bp, Artificial Sequence
  Synthetic Polynucleotide
agtctcgcct

SEQ ID NO: 3320 - DNA, 10 bp, Artificial Sequence
  Synthetic Polynucleotide
gaactcctcg

SEQ ID NO: 3321 - DNA, 10 bp, Artificial Sequence
  Synthetic Polynucleotide
gcagcgaatc

SEQ ID NO: 3322 - DNA, 10 bp, Artificial Sequence
  Synthetic Polynucleotide
tgccttcggg

SEQ ID NO: 3323 - DNA, 10 bp, Artificial Sequence
  Synthetic Polynucleotide
gatctcgtcg

SEQ ID NO: 3324 - DNA, 10 bp, Artificial Sequence
  Synthetic Polynucleotide
gctggcaacc

SEQ ID NO: 3325 - DNA, 10 bp, Artificial Sequence
  Synthetic Polynucleotide
cgaccaccac

SEQ ID NO: 3326 - DNA, 10 bp, Artificial Sequence
  Synthetic Polynucleotide
cgatcaagtc

SEQ ID NO: 3327 - DNA, 10 bp, Artificial Sequence
  Synthetic Polynucleotide
gtaccatcag

SEQ ID NO: 3328 - DNA, 10 bp, Artificial Sequence
  Synthetic Polynucleotide
gaaagagatc

SEQ ID NO: 3329 - DNA, 10 bp, Artificial Sequence
  Synthetic Polynucleotide
gcacgaccgc

SEQ ID NO: 3330 - DNA, 10 bp, Artificial Sequence
  Synthetic Polynucleotide
gaagtatctc

SEQ ID NO: 3331 - DNA, 10 bp, Artificial Sequence
  Synthetic Polynucleotide
agctgttcct

SEQ ID NO: 3332 - DNA, 10 bp, Artificial Sequence
  Synthetic Polynucleotide
ggttacccat

SEQ ID NO: 3333 - DNA, 10 bp, Artificial Sequence
  Synthetic Polynucleotide
catctttcaa

SEQ ID NO: 3334 - DNA, 10 bp, Artificial Sequence
  Synthetic Polynucleotide
taaaggaaaa

SEQ ID NO: 3335 - DNA, 10 bp, Artificial Sequence
  Synthetic Polynucleotide
aaattttctc

SEQ ID NO: 3336 - DNA, 10 bp, Artificial Sequence
  Synthetic Polynucleotide
attattaatt

SEQ ID NO: 3337 - DNA, 10 bp, Artificial Sequence
  Synthetic Polynucleotide
aaaatttgaa

SEQ ID NO: 3338 - DNA, 10 bp, Artificial Sequence
  Synthetic Polynucleotide
ctcaaaacac

SEQ ID NO: 3339 - DNA, 10 bp, Artificial Sequence
  Synthetic Polynucleotide
tagacgtatt

SEQ ID NO: 3340 - DNA, 10 bp, Artificial Sequence
  Synthetic Polynucleotide
acagttgttg

SEQ ID NO: 3341 - DNA, 10 bp, Artificial Sequence
  Synthetic Polynucleotide
ttcttattga

SEQ ID NO: 3342 - DNA, 10 bp, Artificial Sequence
  Synthetic Polynucleotide
gttagacatg

SEQ ID NO: 3343 - DNA, 10 bp, Artificial Sequence
  Synthetic Polynucleotide
tttcttaatc

SEQ ID NO: 3344 - DNA, 10 bp, Artificial Sequence
  Synthetic Polynucleotide
cagtattgaa

SEQ ID NO: 3345 - DNA, 10 bp, Artificial Sequence
  Synthetic Polynucleotide
tagtcaagat

SEQ ID NO: 3346 - DNA, 10 bp, Artificial Sequence
  Synthetic Polynucleotide
tgaggaagat

SEQ ID NO: 3347 - DNA, 10 bp, Artificial Sequence
  Synthetic Polynucleotide
atatgctgtt

SEQ ID NO: 3348 - DNA, 10 bp, Artificial Sequence
  Synthetic Polynucleotide
agaggagacc

SEQ ID NO: 3349 - DNA, 10 bp, Artificial Sequence
  Synthetic Polynucleotide
ccctatcagg

SEQ ID NO: 3350 - DNA, 10 bp, Artificial Sequence
  Synthetic Polynucleotide
gccatagtgg

SEQ ID NO: 3351 - DNA, 10 bp, Artificial Sequence
  Synthetic Polynucleotide
tccatgtgcc

SEQ ID NO: 3352 - DNA, 10 bp, Artificial Sequence
  Synthetic Polynucleotide
taggactagc

SEQ ID NO: 3353 - DNA, 10 bp, Artificial Sequence
  Synthetic Polynucleotide
ccatcatgtt

SEQ ID NO: 3354 - DNA, 10 bp, Artificial Sequence
  Synthetic Polynucleotide
atgactgaca

SEQ ID NO: 3355 - DNA, 10 bp, Artificial Sequence
  Synthetic Polynucleotide
tgtcccatcc

SEQ ID NO: 3356 - DNA, 10 bp, Artificial Sequence
  Synthetic Polynucleotide
acatgtggct

SEQ ID NO: 3357 - DNA, 10 bp, Artificial Sequence
  Synthetic Polynucleotide
cctgtggacc

SEQ ID NO: 3358 - DNA, 10 bp, Artificial Sequence
  Synthetic Polynucleotide
gtaaatcccg

SEQ ID NO: 3359 - DNA, 10 bp, Artificial Sequence
  Synthetic Polynucleotide
tcatcaccac

SEQ ID NO: 3360 - DNA, 10 bp, Artificial Sequence
  Synthetic Polynucleotide
agaaaagaaa

SEQ ID NO: 3361 - DNA, 10 bp, Artificial Sequence
  Synthetic Polynucleotide
ttcatcatca

SEQ ID NO: 3362 - DNA, 10 bp, Artificial Sequence
  Synthetic Polynucleotide
aaggtcatcg

SEQ ID NO: 3363 - DNA, 10 bp, Artificial Sequence
  Synthetic Polynucleotide
gtgttcaagg

SEQ ID NO: 3364 - DNA, 10 bp, Artificial Sequence
  Synthetic Polynucleotide
gtgaaagtag

SEQ ID NO: 3365 - DNA, 10 bp, Artificial Sequence
  Synthetic Polynucleotide
atgccaaagt

SEQ ID NO: 3366 - DNA, 10 bp, Artificial Sequence
  Synthetic Polynucleotide
ttcaaagaaa

SEQ ID NO: 3367 - DNA, 10 bp, Artificial Sequence
  Synthetic Polynucleotide
ttctccatca

SEQ ID NO: 3368 - DNA, 10 bp, Artificial Sequence
  Synthetic Polynucleotide
gtcaccgcag

SEQ ID NO: 3369 - DNA, 10 bp, Artificial Sequence
  Synthetic Polynucleotide
tgaccaccac

SEQ ID NO: 3370 - DNA, 10 bp, Artificial Sequence
  Synthetic Polynucleotide
ggatgagttg

SEQ ID NO: 3371 - DNA, 10 bp, Artificial Sequence
  Synthetic Polynucleotide
cagcagttag

SEQ ID NO: 3372 - DNA, 10 bp, Artificial Sequence
  Synthetic Polynucleotide
caacaaagaa

SEQ ID NO: 3373 - DNA, 10 bp, Artificial Sequence
  Synthetic Polynucleotide
gtgactccat

SEQ ID NO: 3374 - DNA, 10 bp, Artificial Sequence
  Synthetic Polynucleotide
ggttaagttt

SEQ ID NO: 3375 - DNA, 10 bp, Artificial Sequence
  Synthetic Polynucleotide
cacatccata

SEQ ID NO: 3376 - DNA, 10 bp, Artificial Sequence
  Synthetic Polynucleotide
atgatatgtg

SEQ ID NO: 3377 - DNA, 10 bp, Artificial Sequence
  Synthetic Polynucleotide
cgaagaagtc

SEQ ID NO: 3378 - DNA, 10 bp, Artificial Sequence
  Synthetic Polynucleotide
gggttaagtt

SEQ ID NO: 3379 - DNA, 10 bp, Artificial Sequence
  Synthetic Polynucleotide
acatgtcatc

SEQ ID NO: 3380 - DNA, 10 bp, Artificial Sequence
  Synthetic Polynucleotide
gattatgagg

SEQ ID NO: 3381 - DNA, 10 bp, Artificial Sequence
  Synthetic Polynucleotide
tgtaatcctc

SEQ ID NO: 3382 - DNA, 10 bp, Artificial Sequence
  Synthetic Polynucleotide
aaaagattga

SEQ ID NO: 3383 - DNA, 10 bp, Artificial Sequence
  Synthetic Polynucleotide
gcttgttggt

SEQ ID NO: 3384 - DNA, 10 bp, Artificial Sequence
  Synthetic Polynucleotide
tcaatgccac

SEQ ID NO: 3385 - DNA, 10 bp, Artificial Sequence
  Synthetic Polynucleotide
atgcaaaatc

SEQ ID NO: 3386 - DNA, 10 bp, Artificial Sequence
  Synthetic Polynucleotide
gaaattgatt

SEQ ID NO: 3387 - DNA, 10 bp, Artificial Sequence
  Synthetic Polynucleotide
cactcagtgt

SEQ ID NO: 3388 - DNA, 10 bp, Artificial Sequence
  Synthetic Polynucleotide
aatgggtcaa

SEQ ID NO: 3389 - DNA, 10 bp, Artificial Sequence
  Synthetic Polynucleotide
ccatcttgtg

SEQ ID NO: 3390 - DNA, 10 bp, Artificial Sequence
  Synthetic Polynucleotide
tgggtgaaga

SEQ ID NO: 3391 - DNA, 10 bp, Artificial Sequence
  Synthetic Polynucleotide
tgaggtagcc

SEQ ID NO: 3392 - DNA, 10 bp, Artificial Sequence
  Synthetic Polynucleotide
tgcaacatcg

SEQ ID NO: 3393 - DNA, 10 bp, Artificial Sequence
  Synthetic Polynucleotide
tatcatctcc

SEQ ID NO: 3394 - DNA, 10 bp, Artificial Sequence
  Synthetic Polynucleotide
gtctgattat

SEQ ID NO: 3395 - DNA, 10 bp, Artificial Sequence
  Synthetic Polynucleotide
ttcggtttcc

SEQ ID NO: 3396 - DNA, 10 bp, Artificial Sequence
  Synthetic Polynucleotide
tccaacctgt

SEQ ID NO: 3397 - DNA, 10 bp, Artificial Sequence
  Synthetic Polynucleotide
ccatttcttg

SEQ ID NO: 3398 - DNA, 10 bp, Artificial Sequence
  Synthetic Polynucleotide
tttaggtccc

SEQ ID NO: 3399 - DNA, 10 bp, Artificial Sequence
  Synthetic Polynucleotide
tgtctttgtc

SEQ ID NO: 3400 - DNA, 10 bp, Artificial Sequence
  Synthetic Polynucleotide
gctaagctat

SEQ ID NO: 3401 - DNA, 10 bp, Artificial Sequence
  Synthetic Polynucleotide
cgcaaagtta

SEQ ID NO: 3402 - DNA, 10 bp, Artificial Sequence
  Synthetic Polynucleotide
atagataatt

SEQ ID NO: 3403 - DNA, 10 bp, Artificial Sequence
  Synthetic Polynucleotide
atcactcctc

SEQ ID NO: 3404 - DNA, 10 bp, Artificial Sequence
  Synthetic Polynucleotide
tttcaagcac

SEQ ID NO: 3405 - DNA, 10 bp, Artificial Sequence
  Synthetic Polynucleotide
ctcctctctt

SEQ ID NO: 3406 - DNA, 10 bp, Artificial Sequence
  Synthetic Polynucleotide
cagatagacg

SEQ ID NO: 3407 - DNA, 10 bp, Artificial Sequence
  Synthetic Polynucleotide
gttgatgaat

SEQ ID NO: 3408 - DNA, 10 bp, Artificial Sequence
  Synthetic Polynucleotide
ccagaagcaa

SEQ ID NO: 3409 - DNA, 10 bp, Artificial Sequence
  Synthetic Polynucleotide
tgtttaattt

SEQ ID NO: 3410 - DNA, 10 bp, Artificial Sequence
  Synthetic Polynucleotide
tgtgaaataa

SEQ ID NO: 3411 - DNA, 10 bp, Artificial Sequence
  Synthetic Polynucleotide
aggtcttttg

SEQ ID NO: 3412 - DNA, 10 bp, Artificial Sequence
  Synthetic Polynucleotide
ctgcactctc

SEQ ID NO: 3413 - DNA, 10 bp, Artificial Sequence
  Synthetic Polynucleotide
taataattga

SEQ ID NO: 3414 - DNA, 10 bp, Artificial Sequence
  Synthetic Polynucleotide
atgcagattt

SEQ ID NO: 3415 - DNA, 10 bp, Artificial Sequence
  Synthetic Polynucleotide
caaacatggt

SEQ ID NO: 3416 - DNA, 10 bp, Artificial Sequence
  Synthetic Polynucleotide
cggaacagaa

SEQ ID NO: 3417 - DNA, 10 bp, Artificial Sequence
  Synthetic Polynucleotide
ttaatgtatt

SEQ ID NO: 3418 - DNA, 10 bp, Artificial Sequence
  Synthetic Polynucleotide
tatacccatt

SEQ ID NO: 3419 - DNA, 10 bp, Artificial Sequence
  Synthetic Polynucleotide
aaattaaagg

SEQ ID NO: 3420 - DNA, 10 bp, Artificial Sequence
  Synthetic Polynucleotide
cccctgtgcg

SEQ ID NO: 3421 - DNA, 10 bp, Artificial Sequence
  Synthetic Polynucleotide
tttattaatt

SEQ ID NO: 3422 - DNA, 10 bp, Artificial Sequence
  Synthetic Polynucleotide
ttgtatatgg

SEQ ID NO: 3423 - DNA, 10 bp, Artificial Sequence
  Synthetic Polynucleotide
ttcttccact

SEQ ID NO: 3424 - DNA, 10 bp, Artificial Sequence
  Synthetic Polynucleotide
tcgtggtgaa

SEQ ID NO: 3425 - DNA, 10 bp, Artificial Sequence
  Synthetic Polynucleotide
taactgagat

SEQ ID NO: 3426 - DNA, 10 bp, Artificial Sequence
  Synthetic Polynucleotide
agatctatgt

SEQ ID NO: 3427 - DNA, 10 bp, Artificial Sequence
  Synthetic Polynucleotide
cgtcattgat

SEQ ID NO: 3428 - DNA, 10 bp, Artificial Sequence
  Synthetic Polynucleotide
tgtggttgaa

SEQ ID NO: 3429 - DNA, 10 bp, Artificial Sequence
  Synthetic Polynucleotide
taattcaaat

SEQ ID NO: 3430 - DNA, 10 bp, Artificial Sequence
  Synthetic Polynucleotide
ccggatggcc

SEQ ID NO: 3431 - DNA, 10 bp, Artificial Sequence
  Synthetic Polynucleotide
cttcctgggc

SEQ ID NO: 3432 - DNA, 10 bp, Artificial Sequence
  Synthetic Polynucleotide
tattttattt

SEQ ID NO: 3433 - DNA, 10 bp, Artificial Sequence
  Synthetic Polynucleotide
taatttccac

SEQ ID NO: 3434 - DNA, 10 bp, Artificial Sequence
  Synthetic Polynucleotide
tacatcaagt

SEQ ID NO: 3435 - DNA, 10 bp, Artificial Sequence
  Synthetic Polynucleotide
ggagagttga

SEQ ID NO: 3436 - DNA, 10 bp, Artificial Sequence
  Synthetic Polynucleotide
aattacattg

SEQ ID NO: 3437 - DNA, 10 bp, Artificial Sequence
  Synthetic Polynucleotide
cggcgaaaca

SEQ ID NO: 3438 - DNA, 10 bp, Artificial Sequence
  Synthetic Polynucleotide
gttggatgtc

SEQ ID NO: 3439 - DNA, 10 bp, Artificial Sequence
  Synthetic Polynucleotide
cactacttct

SEQ ID NO: 3440 - DNA, 10 bp, Artificial Sequence
  Synthetic Polynucleotide
cagaagtcta

SEQ ID NO: 3441 - DNA, 10 bp, Artificial Sequence
  Synthetic Polynucleotide
tcccaaaatc

SEQ ID NO: 3442 - DNA, 10 bp, Artificial Sequence
  Synthetic Polynucleotide
cctattagac

SEQ ID NO: 3443 - DNA, 10 bp, Artificial Sequence
  Synthetic Polynucleotide
tacatctgcg

SEQ ID NO: 3444 - DNA, 10 bp, Artificial Sequence
  Synthetic Polynucleotide
attttcttct

SEQ ID NO: 3445 - DNA, 10 bp, Artificial Sequence
  Synthetic Polynucleotide
ttgcaccgaa

SEQ ID NO: 3446 - DNA, 10 bp, Artificial Sequence
  Synthetic Polynucleotide
attgaacgtg

SEQ ID NO: 3447 - DNA, 10 bp, Artificial Sequence
  Synthetic Polynucleotide
tttctggtcc

SEQ ID NO: 3448 - DNA, 10 bp, Artificial Sequence
  Synthetic Polynucleotide
ttcaaagacg

SEQ ID NO: 3449 - DNA, 10 bp, Artificial Sequence
  Synthetic Polynucleotide
ccatggtgaa

SEQ ID NO: 3450 - DNA, 10 bp, Artificial Sequence
  Synthetic Polynucleotide
gaaggacatc

SEQ ID NO: 3451 - DNA, 10 bp, Artificial Sequence
  Synthetic Polynucleotide
ctccagtcga

SEQ ID NO: 3452 - DNA, 10 bp, Artificial Sequence
  Synthetic Polynucleotide
cattttgaac

SEQ ID NO: 3453 - DNA, 10 bp, Artificial Sequence
  Synthetic Polynucleotide
ttgcgagcag

SEQ ID NO: 3454 - DNA, 10 bp, Artificial Sequence
  Synthetic Polynucleotide
ggtatttgta

SEQ ID NO: 3455 - DNA, 10 bp, Artificial Sequence
  Synthetic Polynucleotide
tatcacgccc

SEQ ID NO: 3456 - DNA, 10 bp, Artificial Sequence
  Synthetic Polynucleotide
tttgtgggaa

SEQ ID NO: 3457 - DNA, 10 bp, Artificial Sequence
  Synthetic Polynucleotide
agaagatgag

SEQ ID NO: 3458 - DNA, 10 bp, Artificial Sequence
  Synthetic Polynucleotide
gacttctctc

SEQ ID NO: 3459 - DNA, 10 bp, Artificial Sequence
  Synthetic Polynucleotide
aggaagatga

SEQ ID NO: 3460 - DNA, 10 bp, Artificial Sequence
  Synthetic Polynucleotide
tttcttgttg

SEQ ID NO: 3461 - DNA, 10 bp, Artificial Sequence
  Synthetic Polynucleotide
tacagcctcc

SEQ ID NO: 3462 - DNA, 10 bp, Artificial Sequence
  Synthetic Polynucleotide
catggctgct

SEQ ID NO: 3463 - DNA, 10 bp, Artificial Sequence
  Synthetic Polynucleotide
gtcaccccag

SEQ ID NO: 3464 - DNA, 10 bp, Artificial Sequence
  Synthetic Polynucleotide
tgaataacat

SEQ ID NO: 3465 - DNA, 10 bp, Artificial Sequence
  Synthetic Polynucleotide
ttcccatagt

SEQ ID NO: 3466 - DNA, 10 bp, Artificial Sequence
  Synthetic Polynucleotide
aggatgccgt

SEQ ID NO: 3467 - DNA, 10 bp, Artificial Sequence
  Synthetic Polynucleotide
gacggggacg

SEQ ID NO: 3468 - DNA, 10 bp, Artificial Sequence
  Synthetic Polynucleotide
gtcctcgtcc

SEQ ID NO: 3469 - DNA, 10 bp, Artificial Sequence
  Synthetic Polynucleotide
cgccgccgcc

SEQ ID NO: 3470 - DNA, 10 bp, Artificial Sequence
  Synthetic Polynucleotide
gcgccgccgc

SEQ ID NO: 3471 - DNA, 10 bp, Artificial Sequence
  Synthetic Polynucleotide
ataaaacaca

SEQ ID NO: 3472 - DNA, 10 bp, Artificial Sequence
  Synthetic Polynucleotide
gcctgtcaaa

SEQ ID NO: 3473 - DNA, 10 bp, Artificial Sequence
  Synthetic Polynucleotide
tattttaaaa

SEQ ID NO: 3474 - DNA, 10 bp, Artificial Sequence
  Synthetic Polynucleotide
atcttgaaat

SEQ ID NO: 3475 - DNA, 10 bp, Artificial Sequence
  Synthetic Polynucleotide
tgtttatgtt

SEQ ID NO: 3476 - DNA, 10 bp, Artificial Sequence
  Synthetic Polynucleotide
gccatcataa

SEQ ID NO: 3477 - DNA, 10 bp, Artificial Sequence
  Synthetic Polynucleotide
aaaataaaca

SEQ ID NO: 3478 - DNA, 10 bp, Artificial Sequence
  Synthetic Polynucleotide
tttggaaaat

SEQ ID NO: 3479 - DNA, 10 bp, Artificial Sequence
  Synthetic Polynucleotide
ttcatcatat

SEQ ID NO: 3480 - DNA, 10 bp, Artificial Sequence
  Synthetic Polynucleotide
atcaacaaat

SEQ ID NO: 3481 - DNA, 10 bp, Artificial Sequence
  Synthetic Polynucleotide
ctgccgctgc

SEQ ID NO: 3482 - DNA, 10 bp, Artificial Sequence
  Synthetic Polynucleotide
ttgactacat

SEQ ID NO: 3483 - DNA, 10 bp, Artificial Sequence
  Synthetic Polynucleotide
gtcttcgtcg

SEQ ID NO: 3484 - DNA, 10 bp, Artificial Sequence
  Synthetic Polynucleotide
gggtctgcaa

SEQ ID NO: 3485 - DNA, 10 bp, Artificial Sequence
  Synthetic Polynucleotide
ccgcatagag

SEQ ID NO: 3486 - DNA, 10 bp, Artificial Sequence
  Synthetic Polynucleotide
ggccacttta

SEQ ID NO: 3487 - DNA, 10 bp, Artificial Sequence
  Synthetic Polynucleotide
ttgtggtgga

SEQ ID NO: 3488 - DNA, 10 bp, Artificial Sequence
  Synthetic Polynucleotide
gcgaaggagg

SEQ ID NO: 3489 - DNA, 10 bp, Artificial Sequence
  Synthetic Polynucleotide
cacagttcag

SEQ ID NO: 3490 - DNA, 10 bp, Artificial Sequence
  Synthetic Polynucleotide
acatcaatcg

SEQ ID NO: 3491 - DNA, 10 bp, Artificial Sequence
  Synthetic Polynucleotide
acggtttcaa

SEQ ID NO: 3492 - DNA, 10 bp, Artificial Sequence
  Synthetic Polynucleotide
gtatctacaa

SEQ ID NO: 3493 - DNA, 10 bp, Artificial Sequence
  Synthetic Polynucleotide
ccatatttaa

SEQ ID NO: 3494 - DNA, 10 bp, Artificial Sequence
  Synthetic Polynucleotide
gggatattat

SEQ ID NO: 3495 - DNA, 10 bp, Artificial Sequence
  Synthetic Polynucleotide
tatttatttt

SEQ ID NO: 3496 - DNA, 10 bp, Artificial Sequence
  Synthetic Polynucleotide
atagtaaaga

SEQ ID NO: 3497 - DNA, 10 bp, Artificial Sequence
  Synthetic Polynucleotide
aggctttagc

SEQ ID NO: 3498 - DNA, 10 bp, Artificial Sequence
  Synthetic Polynucleotide
atgaagaacc

SEQ ID NO: 3499 - DNA, 10 bp, Artificial Sequence
  Synthetic Polynucleotide
gccgccaacg

SEQ ID NO: 3500 - DNA, 10 bp, Artificial Sequence
  Synthetic Polynucleotide
ggtgacgatg

SEQ ID NO: 3501 - DNA, 10 bp, Artificial Sequence
  Synthetic Polynucleotide
cgccaggact

SEQ ID NO: 3502 - DNA, 10 bp, Artificial Sequence
  Synthetic Polynucleotide
cgtcgatgta

SEQ ID NO: 3503 - DNA, 10 bp, Artificial Sequence
  Synthetic Polynucleotide
ataaagttag

SEQ ID NO: 3504 - DNA, 10 bp, Artificial Sequence
  Synthetic Polynucleotide
aagagcaatt

SEQ ID NO: 3505 - DNA, 10 bp, Artificial Sequence
  Synthetic Polynucleotide
ttttaaaatt

SEQ ID NO: 3506 - DNA, 10 bp, Artificial Sequence
  Synthetic Polynucleotide
taaaatattt

SEQ ID NO: 3507 - DNA, 10 bp, Artificial Sequence
  Synthetic Polynucleotide
tcatcatcaa

SEQ ID NO: 3508 - DNA, 10 bp, Artificial Sequence
  Synthetic Polynucleotide
aaacaccacc

SEQ ID NO: 3509 - DNA, 10 bp, Artificial Sequence
  Synthetic Polynucleotide
atcatggact

SEQ ID NO: 3510 - DNA, 10 bp, Artificial Sequence
  Synthetic Polynucleotide
agatcgggct

SEQ ID NO: 3511 - DNA, 10 bp, Artificial Sequence
  Synthetic Polynucleotide
ccaacgtcag

SEQ ID NO: 3512 - DNA, 10 bp, Artificial Sequence
  Synthetic Polynucleotide
ggtggttctc

SEQ ID NO: 3513 - DNA, 10 bp, Artificial Sequence
  Synthetic Polynucleotide
cagtaactcg

SEQ ID NO: 3514 - DNA, 10 bp, Artificial Sequence
  Synthetic Polynucleotide
aacagtaaaa

SEQ ID NO: 3515 - DNA, 10 bp, Artificial Sequence
  Synthetic Polynucleotide
gtttagcatt

SEQ ID NO: 3516 - DNA, 10 bp, Artificial Sequence
  Synthetic Polynucleotide
gaggaaaatc

SEQ ID NO: 3517 - DNA, 10 bp, Artificial Sequence
  Synthetic Polynucleotide
gaaatagata

SEQ ID NO: 3518 - DNA, 10 bp, Artificial Sequence
  Synthetic Polynucleotide
tttagctatt

SEQ ID NO: 3519 - DNA, 10 bp, Artificial Sequence
  Synthetic Polynucleotide
ctacctattt

SEQ ID NO: 3520 - DNA, 10 bp, Artificial Sequence
  Synthetic Polynucleotide
cctaccatga

SEQ ID NO: 3521 - DNA, 10 bp, Artificial Sequence
  Synthetic Polynucleotide
atcttcttct

SEQ ID NO: 3522 - DNA, 10 bp, Artificial Sequence
  Synthetic Polynucleotide
tttagagggg

SEQ ID NO: 3523 - DNA, 10 bp, Artificial Sequence
  Synthetic Polynucleotide
ccgggctacc

SEQ ID NO: 3524 - DNA, 10 bp, Artificial Sequence
  Synthetic Polynucleotide
ccggtttcgg

SEQ ID NO: 3525 - DNA, 10 bp, Artificial Sequence
  Synthetic Polynucleotide
ccgaggtcct

SEQ ID NO: 3526 - DNA, 10 bp, Artificial Sequence
  Synthetic Polynucleotide
ctcctttcaa

SEQ ID NO: 3527 - DNA, 10 bp, Artificial Sequence
  Synthetic Polynucleotide
acgcactttg

SEQ ID NO: 3528 - DNA, 10 bp, Artificial Sequence
  Synthetic Polynucleotide
tgatgatgtt

SEQ ID NO: 3529 - DNA, 10 bp, Artificial Sequence
  Synthetic Polynucleotide
ggcacacaaa

SEQ ID NO: 3530 - DNA, 10 bp, Artificial Sequence
  Synthetic Polynucleotide
taacactata

SEQ ID NO: 3531 - DNA, 10 bp, Artificial Sequence
  Synthetic Polynucleotide
ctcctgaaaa

SEQ ID NO: 3532 - DNA, 10 bp, Artificial Sequence
  Synthetic Polynucleotide
ttctttagat

SEQ ID NO: 3533 - DNA, 10 bp, Artificial Sequence
  Synthetic Polynucleotide
ttcttggaat

SEQ ID NO: 3534 - DNA, 10 bp, Artificial Sequence
  Synthetic Polynucleotide
cacaaggtaa

SEQ ID NO: 3535 - DNA, 10 bp, Artificial Sequence
  Synthetic Polynucleotide
atcttcttca

SEQ ID NO: 3536 - DNA, 10 bp, Artificial Sequence
  Synthetic Polynucleotide
cttctggatt

SEQ ID NO: 3537 - DNA, 10 bp, Artificial Sequence
  Synthetic Polynucleotide
ttgacctgct

SEQ ID NO: 3538 - DNA, 10 bp, Artificial Sequence
  Synthetic Polynucleotide
atgatgtatt

SEQ ID NO: 3539 - DNA, 10 bp, Artificial Sequence
  Synthetic Polynucleotide
ttacctttta

SEQ ID NO: 3540 - DNA, 10 bp, Artificial Sequence
  Synthetic Polynucleotide
ttattgataa

SEQ ID NO: 3541 - DNA, 10 bp, Artificial Sequence
  Synthetic Polynucleotide
ttgatttctt

SEQ ID NO: 3542 - DNA, 10 bp, Artificial Sequence
  Synthetic Polynucleotide
gatgatttat

SEQ ID NO: 3543 - DNA, 10 bp, Artificial Sequence
  Synthetic Polynucleotide
gccaccgccg

SEQ ID NO: 3544 - DNA, 10 bp, Artificial Sequence
  Synthetic Polynucleotide
gccgagctgg

SEQ ID NO: 3545 - DNA, 10 bp, Artificial Sequence
  Synthetic Polynucleotide
gctaagcaaa

SEQ ID NO: 3546 - DNA, 10 bp, Artificial Sequence
  Synthetic Polynucleotide
aatttcttct

SEQ ID NO: 3547 - DNA, 10 bp, Artificial Sequence
  Synthetic Polynucleotide
caatttcttt

SEQ ID NO: 3548 - DNA, 10 bp, Artificial Sequence
  Synthetic Polynucleotide
gaaactttac

SEQ ID NO: 3549 - DNA, 10 bp, Artificial Sequence
  Synthetic Polynucleotide
acagtgaaga

SEQ ID NO: 3550 - DNA, 10 bp, Artificial Sequence
  Synthetic Polynucleotide
ttcatcaaaa

SEQ ID NO: 3551 - DNA, 10 bp, Artificial Sequence
  Synthetic Polynucleotide
tcgaccctgc

SEQ ID NO: 3552 - DNA, 10 bp, Artificial Sequence
  Synthetic Polynucleotide
ttttcaaaat

SEQ ID NO: 3553 - DNA, 10 bp, Artificial Sequence
  Synthetic Polynucleotide
gaaattaaaa

SEQ ID NO: 3554 - DNA, 10 bp, Artificial Sequence
  Synthetic Polynucleotide
ctcgatcagc

SEQ ID NO: 3555 - DNA, 10 bp, Artificial Sequence
  Synthetic Polynucleotide
gcgctgatcg

SEQ ID NO: 3556 - DNA, 10 bp, Artificial Sequence
  Synthetic Polynucleotide
cgagccgatc

SEQ ID NO: 3557 - DNA, 10 bp, Artificial Sequence
  Synthetic Polynucleotide
cgtcgcacag

SEQ ID NO: 3558 - DNA, 10 bp, Artificial Sequence
  Synthetic Polynucleotide
atttgtcttt

SEQ ID NO: 3559 - DNA, 10 bp, Artificial Sequence
  Synthetic Polynucleotide
cgagaaaatc

SEQ ID NO: 3560 - DNA, 10 bp, Artificial Sequence
  Synthetic Polynucleotide
gccgatgccc

SEQ ID NO: 3561 - DNA, 10 bp, Artificial Sequence
  Synthetic Polynucleotide
tttgataatt

SEQ ID NO: 3562 - DNA, 10 bp, Artificial Sequence
  Synthetic Polynucleotide
tgagctttta

SEQ ID NO: 3563 - DNA, 10 bp, Artificial Sequence
  Synthetic Polynucleotide
accgccaatc

SEQ ID NO: 3564 - DNA, 10 bp, Artificial Sequence
  Synthetic Polynucleotide
acagatcctg

SEQ ID NO: 3565 - DNA, 10 bp, Artificial Sequence
  Synthetic Polynucleotide
agtattaccc

SEQ ID NO: 3566 - DNA, 10 bp, Artificial Sequence
  Synthetic Polynucleotide
tcttcttcaa

SEQ ID NO: 3567 - DNA, 10 bp, Artificial Sequence
  Synthetic Polynucleotide
acaattacat

SEQ ID NO: 3568 - DNA, 10 bp, Artificial Sequence
  Synthetic Polynucleotide
tgggtgtatg

SEQ ID NO: 3569 - DNA, 10 bp, Artificial Sequence
  Synthetic Polynucleotide
aactcgggac

SEQ ID NO: 3570 - DNA, 10 bp, Artificial Sequence
  Synthetic Polynucleotide
catacaacac

SEQ ID NO: 3571 - DNA, 10 bp, Artificial Sequence
  Synthetic Polynucleotide
caaccacctt

SEQ ID NO: 3572 - DNA, 10 bp, Artificial Sequence
  Synthetic Polynucleotide
agtatcttcg

SEQ ID NO: 3573 - DNA, 10 bp, Artificial Sequence
  Synthetic Polynucleotide
tcgcttcgcg

SEQ ID NO: 3574 - DNA, 10 bp, Artificial Sequence
  Synthetic Polynucleotide
attgtgtttg

SEQ ID NO: 3575 - DNA, 10 bp, Artificial Sequence
  Synthetic Polynucleotide
tacagttgtt

SEQ ID NO: 3576 - DNA, 10 bp, Artificial Sequence
  Synthetic Polynucleotide
ataatgattt

SEQ ID NO: 3577 - DNA, 10 bp, Artificial Sequence
  Synthetic Polynucleotide
tgattttcct

SEQ ID NO: 3578 - DNA, 10 bp, Artificial Sequence
  Synthetic Polynucleotide
ttcgatagaa

SEQ ID NO: 3579 - DNA, 10 bp, Artificial Sequence
  Synthetic Polynucleotide
agcacttcaa

SEQ ID NO: 3580 - DNA, 10 bp, Artificial Sequence
  Synthetic Polynucleotide
ggattcacct

SEQ ID NO: 3581 - DNA, 10 bp, Artificial Sequence
  Synthetic Polynucleotide
tcatatgtat

SEQ ID NO: 3582 - DNA, 10 bp, Artificial Sequence
  Synthetic Polynucleotide
tgcaactgat

SEQ ID NO: 3583 - DNA, 10 bp, Artificial Sequence
  Synthetic Polynucleotide
ccgtcagggt

SEQ ID NO: 3584 - DNA, 10 bp, Artificial Sequence
  Synthetic Polynucleotide
ggatcctgat

SEQ ID NO: 3585 - DNA, 10 bp, Artificial Sequence
  Synthetic Polynucleotide
atatcatcac

SEQ ID NO: 3586 - DNA, 10 bp, Artificial Sequence
  Synthetic Polynucleotide
attttactta

SEQ ID NO: 3587 - DNA, 10 bp, Artificial Sequence
  Synthetic Polynucleotide
cttaacggta

SEQ ID NO: 3588 - DNA, 10 bp, Artificial Sequence
  Synthetic Polynucleotide
agtttggagt

SEQ ID NO: 3589 - DNA, 10 bp, Artificial Sequence
  Synthetic Polynucleotide
atggaagtaa

SEQ ID NO: 3590 - DNA, 10 bp, Artificial Sequence
  Synthetic Polynucleotide
actccggcag

SEQ ID NO: 3591 - DNA, 10 bp, Artificial Sequence
  Synthetic Polynucleotide
caaaccaatc

SEQ ID NO: 3592 - DNA, 10 bp, Artificial Sequence
  Synthetic Polynucleotide
tggagcagca

SEQ ID NO: 3593 - DNA, 10 bp, Artificial Sequence
  Synthetic Polynucleotide
ctgacacgtt

SEQ ID NO: 3594 - DNA, 10 bp, Artificial Sequence
  Synthetic Polynucleotide
ttcctgcctg

SEQ ID NO: 3595 - DNA, 10 bp, Artificial Sequence
  Synthetic Polynucleotide
agtctgttga

SEQ ID NO: 3596 - DNA, 10 bp, Artificial Sequence
  Synthetic Polynucleotide
tgtgggagag

SEQ ID NO: 3597 - DNA, 10 bp, Artificial Sequence
  Synthetic Polynucleotide
gtagttgtta

SEQ ID NO: 3598 - DNA, 10 bp, Artificial Sequence
  Synthetic Polynucleotide
ttctgaaatg

SEQ ID NO: 3599 - DNA, 10 bp, Artificial Sequence
  Synthetic Polynucleotide
tcaaccaata

SEQ ID NO: 3600 - DNA, 10 bp, Artificial Sequence
  Synthetic Polynucleotide
gaataccgtg

SEQ ID NO: 3601 - DNA, 10 bp, Artificial Sequence
  Synthetic Polynucleotide
cttgtcagtt

SEQ ID NO: 3602 - DNA, 10 bp, Artificial Sequence
  Synthetic Polynucleotide
caatacgcag

SEQ ID NO: 3603 - DNA, 10 bp, Artificial Sequence
  Synthetic Polynucleotide
gaagaccaag

SEQ ID NO: 3604 - DNA, 10 bp, Artificial Sequence
  Synthetic Polynucleotide
tatagagaaa

SEQ ID NO: 3605 - DNA, 10 bp, Artificial Sequence
  Synthetic Polynucleotide
taagaaaatc

SEQ ID NO: 3606 - DNA, 10 bp, Artificial Sequence
  Synthetic Polynucleotide
ttcccaactt

SEQ ID NO: 3607 - DNA, 10 bp, Artificial Sequence
  Synthetic Polynucleotide
taagctgaaa

SEQ ID NO: 3608 - DNA, 10 bp, Artificial Sequence
  Synthetic Polynucleotide
tcctcatcgg

SEQ ID NO: 3609 - DNA, 10 bp, Artificial Sequence
  Synthetic Polynucleotide
atttccatta

SEQ ID NO: 3610 - DNA, 10 bp, Artificial Sequence
  Synthetic Polynucleotide
agaaaattca

SEQ ID NO: 3611 - DNA, 10 bp, Artificial Sequence
  Synthetic Polynucleotide
tccacaatat

SEQ ID NO: 3612 - DNA, 10 bp, Artificial Sequence
  Synthetic Polynucleotide
cttgaaaatt

SEQ ID NO: 3613 - DNA, 10 bp, Artificial Sequence
  Synthetic Polynucleotide
tctctttggg

SEQ ID NO: 3614 - DNA, 10 bp, Artificial Sequence
  Synthetic Polynucleotide
ggtcaggata

SEQ ID NO: 3615 - DNA, 10 bp, Artificial Sequence
  Synthetic Polynucleotide
ttttgttgct

SEQ ID NO: 3616 - DNA, 10 bp, Artificial Sequence
  Synthetic Polynucleotide
tgctttcatt

SEQ ID NO: 3617 - DNA, 10 bp, Artificial Sequence
  Synthetic Polynucleotide
atttcaaatc

SEQ ID NO: 3618 - DNA, 10 bp, Artificial Sequence
  Synthetic Polynucleotide
aatgcttcaa

SEQ ID NO: 3619 - DNA, 10 bp, Artificial Sequence
  Synthetic Polynucleotide
caagggtgtt

SEQ ID NO: 3620 - DNA, 10 bp, Artificial Sequence
  Synthetic Polynucleotide
catacaatgc

SEQ ID NO: 3621 - DNA, 10 bp, Artificial Sequence
  Synthetic Polynucleotide
atgcattcat

SEQ ID NO: 3622 - DNA, 10 bp, Artificial Sequence
  Synthetic Polynucleotide
tgatagatgg

SEQ ID NO: 3623 - DNA, 10 bp, Artificial Sequence
  Synthetic Polynucleotide
gttcttcttc

SEQ ID NO: 3624 - DNA, 10 bp, Artificial Sequence
  Synthetic Polynucleotide
tcatggcaaa

SEQ ID NO: 3625 - DNA, 10 bp, Artificial Sequence
  Synthetic Polynucleotide
tttattattc

SEQ ID NO: 3626 - DNA, 10 bp, Artificial Sequence
  Synthetic Polynucleotide
ggtgaaaaca

SEQ ID NO: 3627 - DNA, 10 bp, Artificial Sequence
  Synthetic Polynucleotide
acataaaagc

SEQ ID NO: 3628 - DNA, 10 bp, Artificial Sequence
  Synthetic Polynucleotide
agagacaact

SEQ ID NO: 3629 - DNA, 10 bp, Artificial Sequence
  Synthetic Polynucleotide
tcttatcgat

SEQ ID NO: 3630 - DNA, 10 bp, Artificial Sequence
  Synthetic Polynucleotide
actgcttgca

SEQ ID NO: 3631 - DNA, 10 bp, Artificial Sequence
  Synthetic Polynucleotide
aatggatggt

SEQ ID NO: 3632 - DNA, 10 bp, Artificial Sequence
  Synthetic Polynucleotide
cctatccaaa

SEQ ID NO: 3633 - DNA, 10 bp, Artificial Sequence
  Synthetic Polynucleotide
agagtctgaa

SEQ ID NO: 3634 - DNA, 10 bp, Artificial Sequence
  Synthetic Polynucleotide
tattattgtt

SEQ ID NO: 3635 - DNA, 10 bp, Artificial Sequence
  Synthetic Polynucleotide
atcagaagat

SEQ ID NO: 3636 - DNA, 10 bp, Artificial Sequence
  Synthetic Polynucleotide
tcaaccattc

SEQ ID NO: 3637 - DNA, 10 bp, Artificial Sequence
  Synthetic Polynucleotide
atgatggaga

SEQ ID NO: 3638 - DNA, 10 bp, Artificial Sequence
  Synthetic Polynucleotide
tgattttcca

SEQ ID NO: 3639 - DNA, 10 bp, Artificial Sequence
  Synthetic Polynucleotide
atcaaaatgc

SEQ ID NO: 3640 - DNA, 10 bp, Artificial Sequence
  Synthetic Polynucleotide
ttatcttttg

SEQ ID NO: 3641 - DNA, 10 bp, Artificial Sequence
  Synthetic Polynucleotide
aagagagaaa

SEQ ID NO: 3642 - DNA, 10 bp, Artificial Sequence
  Synthetic Polynucleotide
attgcttcat

SEQ ID NO: 3643 - DNA, 10 bp, Artificial Sequence
  Synthetic Polynucleotide
caattggaga

SEQ ID NO: 3644 - DNA, 10 bp, Artificial Sequence
  Synthetic Polynucleotide
tcaaggaaag

SEQ ID NO: 3645 - DNA, 10 bp, Artificial Sequence
  Synthetic Polynucleotide
atgtcaatcc

SEQ ID NO: 3646 - DNA, 10 bp, Artificial Sequence
  Synthetic Polynucleotide
actccccgcc

SEQ ID NO: 3647 - DNA, 10 bp, Artificial Sequence
  Synthetic Polynucleotide
caaatgaaaa

SEQ ID NO: 3648 - DNA, 10 bp, Artificial Sequence
  Synthetic Polynucleotide
tttccatgca

SEQ ID NO: 3649 - DNA, 10 bp, Artificial Sequence
  Synthetic Polynucleotide
atagaaggag

SEQ ID NO: 3650 - DNA, 10 bp, Artificial Sequence
  Synthetic Polynucleotide
ggtacattcc

SEQ ID NO: 3651 - DNA, 10 bp, Artificial Sequence
  Synthetic Polynucleotide
ggaaaagctc

SEQ ID NO: 3652 - DNA, 10 bp, Artificial Sequence
  Synthetic Polynucleotide
catcactatg

SEQ ID NO: 3653 - DNA, 10 bp, Artificial Sequence
  Synthetic Polynucleotide
atgaacttgc

SEQ ID NO: 3654 - DNA, 10 bp, Artificial Sequence
  Synthetic Polynucleotide
tccaaacatc

SEQ ID NO: 3655 - DNA, 10 bp, Artificial Sequence
  Synthetic Polynucleotide
gaatgataga

SEQ ID NO: 3656 - DNA, 10 bp, Artificial Sequence
  Synthetic Polynucleotide
ttcttttgac

SEQ ID NO: 3657 - DNA, 10 bp, Artificial Sequence
  Synthetic Polynucleotide
cacattcaca

SEQ ID NO: 3658 - DNA, 10 bp, Artificial Sequence
  Synthetic Polynucleotide
acagttctcc

SEQ ID NO: 3659 - DNA, 10 bp, Artificial Sequence
  Synthetic Polynucleotide
caacatgtct

SEQ ID NO: 3660 - DNA, 10 bp, Artificial Sequence
  Synthetic Polynucleotide
tattctgctc

SEQ ID NO: 3661 - DNA, 10 bp, Artificial Sequence
  Synthetic Polynucleotide
attgaaggaa

SEQ ID NO: 3662 - DNA, 10 bp, Artificial Sequence
  Synthetic Polynucleotide
tgagatttga

SEQ ID NO: 3663 - DNA, 10 bp, Artificial Sequence
  Synthetic Polynucleotide
tgggatcaga

SEQ ID NO: 3664 - DNA, 10 bp, Artificial Sequence
  Synthetic Polynucleotide
aaaaggtttt

SEQ ID NO: 3665 - DNA, 10 bp, Artificial Sequence
  Synthetic Polynucleotide
taaacatgat

SEQ ID NO: 3666 - DNA, 10 bp, Artificial Sequence
  Synthetic Polynucleotide
ttttgatgat

SEQ ID NO: 3667 - DNA, 10 bp, Artificial Sequence
  Synthetic Polynucleotide
gtggtgtaca

SEQ ID NO: 3668 - DNA, 10 bp, Artificial Sequence
  Synthetic Polynucleotide
tcatctctga

SEQ ID NO: 3669 - DNA, 10 bp, Artificial Sequence
  Synthetic Polynucleotide
agcaataaca

SEQ ID NO: 3670 - DNA, 10 bp, Artificial Sequence
  Synthetic Polynucleotide
cactgaagaa

SEQ ID NO: 3671 - DNA, 10 bp, Artificial Sequence
  Synthetic Polynucleotide
cttttgatgt

SEQ ID NO: 3672 - DNA, 10 bp, Artificial Sequence
  Synthetic Polynucleotide
tccaagaaac

SEQ ID NO: 3673 - DNA, 10 bp, Artificial Sequence
  Synthetic Polynucleotide
aggtaataaa

SEQ ID NO: 3674 - DNA, 10 bp, Artificial Sequence
  Synthetic Polynucleotide
tagaaacaag

SEQ ID NO: 3675 - DNA, 10 bp, Artificial Sequence
  Synthetic Polynucleotide
tcctctttat

SEQ ID NO: 3676 - DNA, 10 bp, Artificial Sequence
  Synthetic Polynucleotide
atgcaaacaa

SEQ ID NO: 3677 - DNA, 10 bp, Artificial Sequence
  Synthetic Polynucleotide
cactgaagtt

SEQ ID NO: 3678 - DNA, 10 bp, Artificial Sequence
  Synthetic Polynucleotide
agaccaagaa

SEQ ID NO: 3679 - DNA, 10 bp, Artificial Sequence
  Synthetic Polynucleotide
tcactactct

SEQ ID NO: 3680 - DNA, 10 bp, Artificial Sequence
  Synthetic Polynucleotide
aaaattgtag

SEQ ID NO: 3681 - DNA, 10 bp, Artificial Sequence
  Synthetic Polynucleotide
ccatggcttc

SEQ ID NO: 3682 - DNA, 10 bp, Artificial Sequence
  Synthetic Polynucleotide
cactaatcag

SEQ ID NO: 3683 - DNA, 10 bp, Artificial Sequence
  Synthetic Polynucleotide
agagaaatca

SEQ ID NO: 3684 - DNA, 10 bp, Artificial Sequence
  Synthetic Polynucleotide
tccagaccac

SEQ ID NO: 3685 - DNA, 10 bp, Artificial Sequence
  Synthetic Polynucleotide
gttcttatct

SEQ ID NO: 3686 - DNA, 10 bp, Artificial Sequence
  Synthetic Polynucleotide
ctcccatttt

SEQ ID NO: 3687 - DNA, 10 bp, Artificial Sequence
  Synthetic Polynucleotide
aaaggatgca

SEQ ID NO: 3688 - DNA, 10 bp, Artificial Sequence
  Synthetic Polynucleotide
ggaatagcat

SEQ ID NO: 3689 - DNA, 10 bp, Artificial Sequence
  Synthetic Polynucleotide
gggcgtatat

SEQ ID NO: 3690 - DNA, 10 bp, Artificial Sequence
  Synthetic Polynucleotide
ccacaagatg

SEQ ID NO: 3691 - DNA, 10 bp, Artificial Sequence
  Synthetic Polynucleotide
aaatgtcctc

SEQ ID NO: 3692 - DNA, 10 bp, Artificial Sequence
  Synthetic Polynucleotide
tttattgtac

SEQ ID NO: 3693 - DNA, 10 bp, Artificial Sequence
  Synthetic Polynucleotide
tgagagacca

SEQ ID NO: 3694 - DNA, 10 bp, Artificial Sequence
  Synthetic Polynucleotide
atctgggatt

SEQ ID NO: 3695 - DNA, 10 bp, Artificial Sequence
  Synthetic Polynucleotide
ggagatattc

SEQ ID NO: 3696 - DNA, 10 bp, Artificial Sequence
  Synthetic Polynucleotide
tattgccata

SEQ ID NO: 3697 - DNA, 10 bp, Artificial Sequence
  Synthetic Polynucleotide
taaaacgaaa

SEQ ID NO: 3698 - DNA, 10 bp, Artificial Sequence
  Synthetic Polynucleotide
cacttttaaa

SEQ ID NO: 3699 - DNA, 10 bp, Artificial Sequence
  Synthetic Polynucleotide
aaaacgaaag

SEQ ID NO: 3700 - DNA, 10 bp, Artificial Sequence
  Synthetic Polynucleotide
aagatttcca

SEQ ID NO: 3701 - DNA, 10 bp, Artificial Sequence
  Synthetic Polynucleotide
tagatgatgc

SEQ ID NO: 3702 - DNA, 10 bp, Artificial Sequence
  Synthetic Polynucleotide
tttataccaa

SEQ ID NO: 3703 - DNA, 10 bp, Artificial Sequence
  Synthetic Polynucleotide
gcagccaaaa

SEQ ID NO: 3704 - DNA, 10 bp, Artificial Sequence
  Synthetic Polynucleotide
tgggcatatg

SEQ ID NO: 3705 - DNA, 10 bp, Artificial Sequence
  Synthetic Polynucleotide
taggattttc

SEQ ID NO: 3706 - DNA, 10 bp, Artificial Sequence
  Synthetic Polynucleotide
gatcctaaca

SEQ ID NO: 3707 - DNA, 10 bp, Artificial Sequence
  Synthetic Polynucleotide
ccctcctctt

SEQ ID NO: 3708 - DNA, 10 bp, Artificial Sequence
  Synthetic Polynucleotide
ttaagaaatg

SEQ ID NO: 3709 - DNA, 10 bp, Artificial Sequence
  Synthetic Polynucleotide
caggagtgct

SEQ ID NO: 3710 - DNA, 10 bp, Artificial Sequence
  Synthetic Polynucleotide
ctttgagggg

SEQ ID NO: 3711 - DNA, 10 bp, Artificial Sequence
  Synthetic Polynucleotide
catgcacatc

SEQ ID NO: 3712 - DNA, 10 bp, Artificial Sequence
  Synthetic Polynucleotide
ccactgtcat

SEQ ID NO: 3713 - DNA, 10 bp, Artificial Sequence
  Synthetic Polynucleotide
aaggttccag

SEQ ID NO: 3714 - DNA, 10 bp, Artificial Sequence
  Synthetic Polynucleotide
aaaaggtaac

SEQ ID NO: 3715 - DNA, 10 bp, Artificial Sequence
  Synthetic Polynucleotide
gtatcagggt

SEQ ID NO: 3716 - DNA, 10 bp, Artificial Sequence
  Synthetic Polynucleotide
tatgcagatg

SEQ ID NO: 3717 - DNA, 10 bp, Artificial Sequence
  Synthetic Polynucleotide
ctccagagta

SEQ ID NO: 3718 - DNA, 10 bp, Artificial Sequence
  Synthetic Polynucleotide
aagaagagtg

SEQ ID NO: 3719 - DNA, 10 bp, Artificial Sequence
  Synthetic Polynucleotide
tcatttgagg

SEQ ID NO: 3720 - DNA, 10 bp, Artificial Sequence
  Synthetic Polynucleotide
tggtgcaacc

SEQ ID NO: 3721 - DNA, 10 bp, Artificial Sequence
  Synthetic Polynucleotide
cataatatat

SEQ ID NO: 3722 - DNA, 10 bp, Artificial Sequence
  Synthetic Polynucleotide
ctcaagaagt

SEQ ID NO: 3723 - DNA, 10 bp, Artificial Sequence
  Synthetic Polynucleotide
cctaagtttt

SEQ ID NO: 3724 - DNA, 10 bp, Artificial Sequence
  Synthetic Polynucleotide
tatgatgatg

SEQ ID NO: 3725 - DNA, 10 bp, Artificial Sequence
  Synthetic Polynucleotide
atttgcagtt

SEQ ID NO: 3726 - DNA, 10 bp, Artificial Sequence
  Synthetic Polynucleotide
actcattggg

SEQ ID NO: 3727 - DNA, 10 bp, Artificial Sequence
  Synthetic Polynucleotide
catttatgat

SEQ ID NO: 3728 - DNA, 10 bp, Artificial Sequence
  Synthetic Polynucleotide
tgtattgtga

SEQ ID NO: 3729 - DNA, 10 bp, Artificial Sequence
  Synthetic Polynucleotide
ctctttcttt

SEQ ID NO: 3730 - DNA, 10 bp, Artificial Sequence
  Synthetic Polynucleotide
taaatgacaa

SEQ ID NO: 3731 - DNA, 10 bp, Artificial Sequence
  Synthetic Polynucleotide
tcattgtcca

SEQ ID NO: 3732 - DNA, 10 bp, Artificial Sequence
  Synthetic Polynucleotide
ggattcatct

SEQ ID NO: 3733 - DNA, 10 bp, Artificial Sequence
  Synthetic Polynucleotide
cagcagtcac

SEQ ID NO: 3734 - DNA, 10 bp, Artificial Sequence
  Synthetic Polynucleotide
acaagatgga

SEQ ID NO: 3735 - DNA, 10 bp, Artificial Sequence
  Synthetic Polynucleotide
tgatagtctc

SEQ ID NO: 3736 - DNA, 10 bp, Artificial Sequence
  Synthetic Polynucleotide
tttgagtgga

SEQ ID NO: 3737 - DNA, 10 bp, Artificial Sequence
  Synthetic Polynucleotide
ttcccattaa

SEQ ID NO: 3738 - DNA, 10 bp, Artificial Sequence
  Synthetic Polynucleotide
agagtgggat

SEQ ID NO: 3739 - DNA, 10 bp, Artificial Sequence
  Synthetic Polynucleotide
gcttctaatc

SEQ ID NO: 3740 - DNA, 10 bp, Artificial Sequence
  Synthetic Polynucleotide
ggtcaaagaa

SEQ ID NO: 3741 - DNA, 10 bp, Artificial Sequence
  Synthetic Polynucleotide
tgcctcaacc

SEQ ID NO: 3742 - DNA, 10 bp, Artificial Sequence
  Synthetic Polynucleotide
tttgcatgag

SEQ ID NO: 3743 - DNA, 10 bp, Artificial Sequence
  Synthetic Polynucleotide
ttatcccaca

SEQ ID NO: 3744 - DNA, 10 bp, Artificial Sequence
  Synthetic Polynucleotide
acgacagtgc

SEQ ID NO: 3745 - DNA, 10 bp, Artificial Sequence
  Synthetic Polynucleotide
caggaagtca

SEQ ID NO: 3746 - DNA, 10 bp, Artificial Sequence
  Synthetic Polynucleotide
gagttcaagg

SEQ ID NO: 3747 - DNA, 10 bp, Artificial Sequence
  Synthetic Polynucleotide
cgttccattt

SEQ ID NO: 3748 - DNA, 10 bp, Artificial Sequence
  Synthetic Polynucleotide
cgacgaacac

SEQ ID NO: 3749 - DNA, 10 bp, Artificial Sequence
  Synthetic Polynucleotide
agcgaaccaa

SEQ ID NO: 3750 - DNA, 10 bp, Artificial Sequence
  Synthetic Polynucleotide
agataaaaca

SEQ ID NO: 3751 - DNA, 10 bp, Artificial Sequence
  Synthetic Polynucleotide
cacggttggc

SEQ ID NO: 3752 - DNA, 10 bp, Artificial Sequence
  Synthetic Polynucleotide
agctgaacag

SEQ ID NO: 3753 - DNA, 10 bp, Artificial Sequence
  Synthetic Polynucleotide
tccgaagaag

SEQ ID NO: 3754 - DNA, 10 bp, Artificial Sequence
  Synthetic Polynucleotide
accccgtccc

SEQ ID NO: 3755 - DNA, 10 bp, Artificial Sequence
  Synthetic Polynucleotide
agtcaatctt

SEQ ID NO: 3756 - DNA, 10 bp, Artificial Sequence
  Synthetic Polynucleotide
agtaaaattt

SEQ ID NO: 3757 - DNA, 10 bp, Artificial Sequence
  Synthetic Polynucleotide
gtatcaaaac

SEQ ID NO: 3758 - DNA, 10 bp, Artificial Sequence
  Synthetic Polynucleotide
atggttttac

SEQ ID NO: 3759 - DNA, 10 bp, Artificial Sequence
  Synthetic Polynucleotide
ggtatgaggg

SEQ ID NO: 3760 - DNA, 10 bp, Artificial Sequence
  Synthetic Polynucleotide
aatgctgtat

SEQ ID NO: 3761 - DNA, 10 bp, Artificial Sequence
  Synthetic Polynucleotide
aacattgagg

SEQ ID NO: 3762 - DNA, 10 bp, Artificial Sequence
  Synthetic Polynucleotide
aagtcctacc

SEQ ID NO: 3763 - DNA, 10 bp, Artificial Sequence
  Synthetic Polynucleotide
aaaacaaaag

SEQ ID NO: 3764 - DNA, 10 bp, Artificial Sequence
  Synthetic Polynucleotide
ctctcctcca

SEQ ID NO: 3765 - DNA, 10 bp, Artificial Sequence
  Synthetic Polynucleotide
aattttgaat

SEQ ID NO: 3766 - DNA, 10 bp, Artificial Sequence
  Synthetic Polynucleotide
aagtctatcg

SEQ ID NO: 3767 - DNA, 10 bp, Artificial Sequence
  Synthetic Polynucleotide
cagagggaac

SEQ ID NO: 3768 - DNA, 10 bp, Artificial Sequence
  Synthetic Polynucleotide
tgacgctcaa

SEQ ID NO: 3769 - DNA, 10 bp, Artificial Sequence
  Synthetic Polynucleotide
cattcctctc

SEQ ID NO: 3770 - DNA, 10 bp, Artificial Sequence
  Synthetic Polynucleotide
ttcaacaagt

SEQ ID NO: 3771 - DNA, 10 bp, Artificial Sequence
  Synthetic Polynucleotide
atttacccgg

SEQ ID NO: 3772 - DNA, 10 bp, Artificial Sequence
  Synthetic Polynucleotide
tttattcttc

SEQ ID NO: 3773 - DNA, 10 bp, Artificial Sequence
  Synthetic Polynucleotide
tctgtttgtt

SEQ ID NO: 3774 - DNA, 10 bp, Artificial Sequence
  Synthetic Polynucleotide
ggttttcgtg

SEQ ID NO: 3775 - DNA, 10 bp, Artificial Sequence
  Synthetic Polynucleotide
gaatcctaca

SEQ ID NO: 3776 - DNA, 10 bp, Artificial Sequence
  Synthetic Polynucleotide
ccaaagacta

SEQ ID NO: 3777 - DNA, 10 bp, Artificial Sequence
  Synthetic Polynucleotide
tctgagatct

SEQ ID NO: 3778 - DNA, 10 bp, Artificial Sequence
  Synthetic Polynucleotide
tttagctctt

SEQ ID NO: 3779 - DNA, 10 bp, Artificial Sequence
  Synthetic Polynucleotide
aacattacag

SEQ ID NO: 3780 - DNA, 10 bp, Artificial Sequence
  Synthetic Polynucleotide
ttgttgatga

SEQ ID NO: 3781 - DNA, 10 bp, Artificial Sequence
  Synthetic Polynucleotide
gcattgcgat

SEQ ID NO: 3782 - DNA, 10 bp, Artificial Sequence
  Synthetic Polynucleotide
ttaaatggaa

SEQ ID NO: 3783 - DNA, 10 bp, Artificial Sequence
  Synthetic Polynucleotide
aaaatacact

SEQ ID NO: 3784 - DNA, 10 bp, Artificial Sequence
  Synthetic Polynucleotide
agtcttccgt

SEQ ID NO: 3785 - DNA, 10 bp, Artificial Sequence
  Synthetic Polynucleotide
caagtcaagc

SEQ ID NO: 3786 - DNA, 10 bp, Artificial Sequence
  Synthetic Polynucleotide
catcatccca

SEQ ID NO: 3787 - DNA, 10 bp, Artificial Sequence
  Synthetic Polynucleotide
caatcgtcct

SEQ ID NO: 3788 - DNA, 10 bp, Artificial Sequence
  Synthetic Polynucleotide
taaaacataa

SEQ ID NO: 3789 - DNA, 10 bp, Artificial Sequence
  Synthetic Polynucleotide
tcaataaata

SEQ ID NO: 3790 - DNA, 10 bp, Artificial Sequence
  Synthetic Polynucleotide
tttgtgcatt

SEQ ID NO: 3791 - DNA, 10 bp, Artificial Sequence
  Synthetic Polynucleotide
aaagaaaata

SEQ ID NO: 3792 - DNA, 10 bp, Artificial Sequence
  Synthetic Polynucleotide
cctgtctgag

SEQ ID NO: 3793 - DNA, 10 bp, Artificial Sequence
  Synthetic Polynucleotide
tgtactccaa

SEQ ID NO: 3794 - DNA, 10 bp, Artificial Sequence
  Synthetic Polynucleotide
cttcttcaac

SEQ ID NO: 3795 - DNA, 10 bp, Artificial Sequence
  Synthetic Polynucleotide
aaccaacacc

SEQ ID NO: 3796 - DNA, 10 bp, Artificial Sequence
  Synthetic Polynucleotide
tgcttgtact

SEQ ID NO: 3797 - DNA, 10 bp, Artificial Sequence
  Synthetic Polynucleotide
aatacatttg

SEQ ID NO: 3798 - DNA, 10 bp, Artificial Sequence
  Synthetic Polynucleotide
ttgccaacac

SEQ ID NO: 3799 - DNA, 10 bp, Artificial Sequence
  Synthetic Polynucleotide
cacgacaaag

SEQ ID NO: 3800 - DNA, 10 bp, Artificial Sequence
  Synthetic Polynucleotide
ctttatccga

SEQ ID NO: 3801 - DNA, 10 bp, Artificial Sequence
  Synthetic Polynucleotide
aaaatcttcc

SEQ ID NO: 3802 - DNA, 10 bp, Artificial Sequence
  Synthetic Polynucleotide
tcctgcttct

SEQ ID NO: 3803 - DNA, 10 bp, Artificial Sequence
  Synthetic Polynucleotide
aaatgctgat

SEQ ID NO: 3804 - DNA, 10 bp, Artificial Sequence
  Synthetic Polynucleotide
ttttgaagtg

SEQ ID NO: 3805 - DNA, 10 bp, Artificial Sequence
  Synthetic Polynucleotide
tataataaga

SEQ ID NO: 3806 - DNA, 10 bp, Artificial Sequence
  Synthetic Polynucleotide
tctgaataat

SEQ ID NO: 3807 - DNA, 10 bp, Artificial Sequence
  Synthetic Polynucleotide
atattatact

SEQ ID NO: 3808 - DNA, 10 bp, Artificial Sequence
  Synthetic Polynucleotide
ccaaagtagt

SEQ ID NO: 3809 - DNA, 10 bp, Artificial Sequence
  Synthetic Polynucleotide
tccggcccct

SEQ ID NO: 3810 - DNA, 10 bp, Artificial Sequence
  Synthetic Polynucleotide
agtgatctgt

SEQ ID NO: 3811 - DNA, 10 bp, Artificial Sequence
  Synthetic Polynucleotide
tcctctcctt

SEQ ID NO: 3812 - DNA, 10 bp, Artificial Sequence
  Synthetic Polynucleotide
tagacgtttt

SEQ ID NO: 3813 - DNA, 10 bp, Artificial Sequence
  Synthetic Polynucleotide
aaggatgccc

SEQ ID NO: 3814 - DNA, 10 bp, Artificial Sequence
  Synthetic Polynucleotide
gaaaagtcaa

SEQ ID NO: 3815 - DNA, 10 bp, Artificial Sequence
  Synthetic Polynucleotide
tgttatggag

SEQ ID NO: 3816 - DNA, 10 bp, Artificial Sequence
  Synthetic Polynucleotide
aaatccattt

SEQ ID NO: 3817 - DNA, 10 bp, Artificial Sequence
  Synthetic Polynucleotide
tgaaagatga

SEQ ID NO: 3818 - DNA, 10 bp, Artificial Sequence
  Synthetic Polynucleotide
cttctaagtt

SEQ ID NO: 3819 - DNA, 10 bp, Artificial Sequence
  Synthetic Polynucleotide
ttgtacccac

SEQ ID NO: 3820 - DNA, 10 bp, Artificial Sequence
  Synthetic Polynucleotide
agagccagtc

SEQ ID NO: 3821 - DNA, 10 bp, Artificial Sequence
  Synthetic Polynucleotide
tgaaacctct

SEQ ID NO: 3822 - DNA, 10 bp, Artificial Sequence
  Synthetic Polynucleotide
agaacaaaac

SEQ ID NO: 3823 - DNA, 10 bp, Artificial Sequence
  Synthetic Polynucleotide
ctgatgttga

SEQ ID NO: 3824 - DNA, 10 bp, Artificial Sequence
  Synthetic Polynucleotide
ctgaaacaca

SEQ ID NO: 3825 - DNA, 10 bp, Artificial Sequence
  Synthetic Polynucleotide
tgacaaagat

SEQ ID NO: 3826 - DNA, 10 bp, Artificial Sequence
  Synthetic Polynucleotide
catgttcttg

SEQ ID NO: 3827 - DNA, 10 bp, Artificial Sequence
  Synthetic Polynucleotide
tatggtgatg

SEQ ID NO: 3828 - DNA, 10 bp, Artificial Sequence
  Synthetic Polynucleotide
tagacaatta

SEQ ID NO: 3829 - DNA, 10 bp, Artificial Sequence
  Synthetic Polynucleotide
cctggtaaca

SEQ ID NO: 3830 - DNA, 10 bp, Artificial Sequence
  Synthetic Polynucleotide
tccaaatcca

SEQ ID NO: 3831 - DNA, 10 bp, Artificial Sequence
  Synthetic Polynucleotide
ccatggcaag

SEQ ID NO: 3832 - DNA, 10 bp, Artificial Sequence
  Synthetic Polynucleotide
tatcacttgg

SEQ ID NO: 3833 - DNA, 10 bp, Artificial Sequence
  Synthetic Polynucleotide
tacatctctt

SEQ ID NO: 3834 - DNA, 10 bp, Artificial Sequence
  Synthetic Polynucleotide
ttcaaatttt

SEQ ID NO: 3835 - DNA, 10 bp, Artificial Sequence
  Synthetic Polynucleotide
atgatgttga

SEQ ID NO: 3836 - DNA, 10 bp, Artificial Sequence
  Synthetic Polynucleotide
gtgtatgatt

SEQ ID NO: 3837 - DNA, 10 bp, Artificial Sequence
  Synthetic Polynucleotide
aaactgaaaa

SEQ ID NO: 3838 - DNA, 10 bp, Artificial Sequence
  Synthetic Polynucleotide
tctcacgggc

SEQ ID NO: 3839 - DNA, 10 bp, Artificial Sequence
  Synthetic Polynucleotide
ttggtgctgg

SEQ ID NO: 3840 - DNA, 10 bp, Artificial Sequence
  Synthetic Polynucleotide
gagcatgtct

SEQ ID NO: 3841 - DNA, 10 bp, Artificial Sequence
  Synthetic Polynucleotide
agtatcagca

SEQ ID NO: 3842 - DNA, 10 bp, Artificial Sequence
  Synthetic Polynucleotide
gtctcggtgt

SEQ ID NO: 3843 - DNA, 10 bp, Artificial Sequence
  Synthetic Polynucleotide
caagcagatg

SEQ ID NO: 3844 - DNA, 10 bp, Artificial Sequence
  Synthetic Polynucleotide
tttaatatct

SEQ ID NO: 3845 - DNA, 10 bp, Artificial Sequence
  Synthetic Polynucleotide
ttgataaaga

SEQ ID NO: 3846 - DNA, 10 bp, Artificial Sequence
  Synthetic Polynucleotide
ttcttcttgg

SEQ ID NO: 3847 - DNA, 10 bp, Artificial Sequence
  Synthetic Polynucleotide
ttatctctgg

SEQ ID NO: 3848 - DNA, 10 bp, Artificial Sequence
  Synthetic Polynucleotide
ttgccgccgt

SEQ ID NO: 3849 - DNA, 10 bp, Artificial Sequence
  Synthetic Polynucleotide
gaaggcatgg

SEQ ID NO: 3850 - DNA, 10 bp, Artificial Sequence
  Synthetic Polynucleotide
aaaataaggg

SEQ ID NO: 3851 - DNA, 10 bp, Artificial Sequence
  Synthetic Polynucleotide
tctttgaaga

SEQ ID NO: 3852 - DNA, 10 bp, Artificial Sequence
  Synthetic Polynucleotide
ttagcctctt

SEQ ID NO: 3853 - DNA, 10 bp, Artificial Sequence
  Synthetic Polynucleotide
aaagaaagaa

SEQ ID NO: 3854 - DNA, 10 bp, Artificial Sequence
  Synthetic Polynucleotide
aggaagttca

SEQ ID NO: 3855 - DNA, 10 bp, Artificial Sequence
  Synthetic Polynucleotide
aaccaagcaa

SEQ ID NO: 3856 - DNA, 10 bp, Artificial Sequence
  Synthetic Polynucleotide
atgtgacgga

SEQ ID NO: 3857 - DNA, 10 bp, Artificial Sequence
  Synthetic Polynucleotide
tgaaattgat

SEQ ID NO: 3858 - DNA, 10 bp, Artificial Sequence
  Synthetic Polynucleotide
cttaaggtct

SEQ ID NO: 3859 - DNA, 10 bp, Artificial Sequence
  Synthetic Polynucleotide
gaagggtgca

SEQ ID NO: 3860 - DNA, 10 bp, Artificial Sequence
  Synthetic Polynucleotide
caggtcttga

SEQ ID NO: 3861 - DNA, 10 bp, Artificial Sequence
  Synthetic Polynucleotide
gctgacgcct

SEQ ID NO: 3862 - DNA, 10 bp, Artificial Sequence
  Synthetic Polynucleotide
ttgaagatga

SEQ ID NO: 3863 - DNA, 10 bp, Artificial Sequence
  Synthetic Polynucleotide
ttaaccatat

SEQ ID NO: 3864 - DNA, 10 bp, Artificial Sequence
  Synthetic Polynucleotide
ggcttatcca

SEQ ID NO: 3865 - DNA, 10 bp, Artificial Sequence
  Synthetic Polynucleotide
gctctttccg

SEQ ID NO: 3866 - DNA, 10 bp, Artificial Sequence
  Synthetic Polynucleotide
tctctattaa

SEQ ID NO: 3867 - DNA, 10 bp, Artificial Sequence
  Synthetic Polynucleotide
atgagtggga

SEQ ID NO: 3868 - DNA, 10 bp, Artificial Sequence
  Synthetic Polynucleotide
tggctgtggt

SEQ ID NO: 3869 - DNA, 10 bp, Artificial Sequence
  Synthetic Polynucleotide
tatatagcta

SEQ ID NO: 3870 - DNA, 10 bp, Artificial Sequence
  Synthetic Polynucleotide
tatcttaaag

SEQ ID NO: 3871 - DNA, 10 bp, Artificial Sequence
  Synthetic Polynucleotide
tgtggcgggt

SEQ ID NO: 3872 - DNA, 10 bp, Artificial Sequence
  Synthetic Polynucleotide
ataataataa

SEQ ID NO: 3873 - DNA, 10 bp, Artificial Sequence
  Synthetic Polynucleotide
tattattatt

SEQ ID NO: 3874 - DNA, 10 bp, Artificial Sequence
  Synthetic Polynucleotide
ttatatttat

SEQ ID NO: 3875 - DNA, 10 bp, Artificial Sequence
  Synthetic Polynucleotide
ttatatataa

SEQ ID NO: 3876 - DNA, 10 bp, Artificial Sequence
  Synthetic Polynucleotide
aattaaataa

SEQ ID NO: 3877 - DNA, 10 bp, Artificial Sequence
  Synthetic Polynucleotide
ttattatttt

SEQ ID NO: 3878 - DNA, 10 bp, Artificial Sequence
  Synthetic Polynucleotide
aaattatttt

SEQ ID NO: 3879 - DNA, 10 bp, Artificial Sequence
  Synthetic Polynucleotide
atttatttat

SEQ ID NO: 3880 - DNA, 10 bp, Artificial Sequence
  Synthetic Polynucleotide
atagcaatat

SEQ ID NO: 3881 - DNA, 10 bp, Artificial Sequence
  Synthetic Polynucleotide
ataactcttt

SEQ ID NO: 3882 - DNA, 10 bp, Artificial Sequence
  Synthetic Polynucleotide
atcatcatta

SEQ ID NO: 3883 - DNA, 10 bp, Artificial Sequence
  Synthetic Polynucleotide
ttattacttt

SEQ ID NO: 3884 - DNA, 10 bp, Artificial Sequence
  Synthetic Polynucleotide
aaaatataaa

SEQ ID NO: 3885 - DNA, 10 bp, Artificial Sequence
  Synthetic Polynucleotide
aaattaaata

SEQ ID NO: 3886 - DNA, 10 bp, Artificial Sequence
  Synthetic Polynucleotide
tattgaaata

SEQ ID NO: 3887 - DNA, 10 bp, Artificial Sequence
  Synthetic Polynucleotide
tattttattt

SEQ ID NO: 3888 - DNA, 10 bp, Artificial Sequence
  Synthetic Polynucleotide
aaatcaacaa

SEQ ID NO: 3889 - DNA, 10 bp, Artificial Sequence
  Synthetic Polynucleotide
actgcgaaga

SEQ ID NO: 3890 - DNA, 10 bp, Artificial Sequence
  Synthetic Polynucleotide
tgttttattt

SEQ ID NO: 3891 - DNA, 10 bp, Artificial Sequence
  Synthetic Polynucleotide
aaacaaaaca

SEQ ID NO: 3892 - DNA, 10 bp, Artificial Sequence
  Synthetic Polynucleotide
attgtcacgc

SEQ ID NO: 3893 - DNA, 10 bp, Artificial Sequence
  Synthetic Polynucleotide
aaataaatgt

SEQ ID NO: 3894 - DNA, 10 bp, Artificial Sequence
  Synthetic Polynucleotide
gctttattga

SEQ ID NO: 3895 - DNA, 10 bp, Artificial Sequence
  Synthetic Polynucleotide
ttattttaaa

SEQ ID NO: 3896 - DNA, 10 bp, Artificial Sequence
  Synthetic Polynucleotide
aactctttaa

SEQ ID NO: 3897 - DNA, 10 bp, Artificial Sequence
  Synthetic Polynucleotide
atccaacgag

SEQ ID NO: 3898 - DNA, 10 bp, Artificial Sequence
  Synthetic Polynucleotide
aatgtaaaca

SEQ ID NO: 3899 - DNA, 10 bp, Artificial Sequence
  Synthetic Polynucleotide
attctttcgt

SEQ ID NO: 3900 - DNA, 10 bp, Artificial Sequence
  Synthetic Polynucleotide
tacagtcagt

SEQ ID NO: 3901 - DNA, 10 bp, Artificial Sequence
  Synthetic Polynucleotide
tgagctgtag

SEQ ID NO: 3902 - DNA, 10 bp, Artificial Sequence
  Synthetic Polynucleotide
gtgtggcagg

SEQ ID NO: 3903 - DNA, 10 bp, Artificial Sequence
  Synthetic Polynucleotide
ttatatatct

SEQ ID NO: 3904 - DNA, 10 bp, Artificial Sequence
  Synthetic Polynucleotide
ttgttttctt

SEQ ID NO: 3905 - DNA, 10 bp, Artificial Sequence
  Synthetic Polynucleotide
aaaataaatt

SEQ ID NO: 3906 - DNA, 10 bp, Artificial Sequence
  Synthetic Polynucleotide
agtaggtata

SEQ ID NO: 3907 - DNA, 10 bp, Artificial Sequence
  Synthetic Polynucleotide
attatcagaa

SEQ ID NO: 3908 - DNA, 10 bp, Artificial Sequence
  Synthetic Polynucleotide
ttaccattaa

SEQ ID NO: 3909 - DNA, 10 bp, Artificial Sequence
  Synthetic Polynucleotide
taaaatatat

SEQ ID NO: 3910 - DNA, 10 bp, Artificial Sequence
  Synthetic Polynucleotide
acaaacatgt

SEQ ID NO: 3911 - DNA, 10 bp, Artificial Sequence
  Synthetic Polynucleotide
aagttgaaat

SEQ ID NO: 3912 - DNA, 10 bp, Artificial Sequence
  Synthetic Polynucleotide
ttctgaagaa

SEQ ID NO: 3913 - DNA, 10 bp, Artificial Sequence
  Synthetic Polynucleotide
cgttgcttgg

SEQ ID NO: 3914 - DNA, 10 bp, Artificial Sequence
  Synthetic Polynucleotide
accagaacca

SEQ ID NO: 3915 - DNA, 10 bp, Artificial Sequence
  Synthetic Polynucleotide
aagattttca

SEQ ID NO: 3916 - DNA, 10 bp, Artificial Sequence
  Synthetic Polynucleotide
attcattgaa

SEQ ID NO: 3917 - DNA, 10 bp, Artificial Sequence
  Synthetic Polynucleotide
tataaaatac

SEQ ID NO: 3918 - DNA, 10 bp, Artificial Sequence
  Synthetic Polynucleotide
gcatttagag

SEQ ID NO: 3919 - DNA, 10 bp, Artificial Sequence
  Synthetic Polynucleotide
gcactttgta

SEQ ID NO: 3920 - DNA, 10 bp, Artificial Sequence
  Synthetic Polynucleotide
attattattc

SEQ ID NO: 3921 - DNA, 10 bp, Artificial Sequence
  Synthetic Polynucleotide
ttttatttgt

SEQ ID NO: 3922 - DNA, 10 bp, Artificial Sequence
  Synthetic Polynucleotide
gtttctattt

SEQ ID NO: 3923 - DNA, 10 bp, Artificial Sequence
  Synthetic Polynucleotide
acagtaatta

SEQ ID NO: 3924 - DNA, 10 bp, Artificial Sequence
  Synthetic Polynucleotide
gtcttacaat

SEQ ID NO: 3925 - DNA, 10 bp, Artificial Sequence
  Synthetic Polynucleotide
caagcgtata

SEQ ID NO: 3926 - DNA, 10 bp, Artificial Sequence
  Synthetic Polynucleotide
caagaagaaa

SEQ ID NO: 3927 - DNA, 10 bp, Artificial Sequence
  Synthetic Polynucleotide
ctgcaatcgc

SEQ ID NO: 3928 - DNA, 10 bp, Artificial Sequence
  Synthetic Polynucleotide
gtgttgttta

SEQ ID NO: 3929 - DNA, 10 bp, Artificial Sequence
  Synthetic Polynucleotide
agaatgcacg

SEQ ID NO: 3930 - DNA, 10 bp, Artificial Sequence
  Synthetic Polynucleotide
ttcatccata

SEQ ID NO: 3931 - DNA, 10 bp, Artificial Sequence
  Synthetic Polynucleotide
tgaacattct

SEQ ID NO: 3932 - DNA, 10 bp, Artificial Sequence
  Synthetic Polynucleotide
tctattgttg

SEQ ID NO: 3933 - DNA, 10 bp, Artificial Sequence
  Synthetic Polynucleotide
tggaaacgtg

SEQ ID NO: 3934 - DNA, 10 bp, Artificial Sequence
  Synthetic Polynucleotide
gtagaaatat

SEQ ID NO: 3935 - DNA, 10 bp, Artificial Sequence
  Synthetic Polynucleotide
tgctatagaa

SEQ ID NO: 3936 - DNA, 10 bp, Artificial Sequence
  Synthetic Polynucleotide
tttacgatat

SEQ ID NO: 3937 - DNA, 10 bp, Artificial Sequence
  Synthetic Polynucleotide
agtgagaatg

SEQ ID NO: 3938 - DNA, 10 bp, Artificial Sequence
  Synthetic Polynucleotide
atattatggt

SEQ ID NO: 3939 - DNA, 10 bp, Artificial Sequence
  Synthetic Polynucleotide
acaaactttt

SEQ ID NO: 3940 - DNA, 10 bp, Artificial Sequence
  Synthetic Polynucleotide
tcgtccaacc

SEQ ID NO: 3941 - DNA, 10 bp, Artificial Sequence
  Synthetic Polynucleotide
aatagagtat

SEQ ID NO: 3942 - DNA, 10 bp, Artificial Sequence
  Synthetic Polynucleotide
aaacagtctg

SEQ ID NO: 3943 - DNA, 10 bp, Artificial Sequence
  Synthetic Polynucleotide
gaacaccgac

SEQ ID NO: 3944 - DNA, 10 bp, Artificial Sequence
  Synthetic Polynucleotide
tatcagtgac

SEQ ID NO: 3945 - DNA, 10 bp, Artificial Sequence
  Synthetic Polynucleotide
caatttctga

SEQ ID NO: 3946 - DNA, 10 bp, Artificial Sequence
  Synthetic Polynucleotide
tcggcttata

SEQ ID NO: 3947 - DNA, 10 bp, Artificial Sequence
  Synthetic Polynucleotide
agaagaagat

SEQ ID NO: 3948 - DNA, 10 bp, Artificial Sequence
  Synthetic Polynucleotide
caacctatgg

SEQ ID NO: 3949 - DNA, 10 bp, Artificial Sequence
  Synthetic Polynucleotide
tcttctacct

SEQ ID NO: 3950 - DNA, 10 bp, Artificial Sequence
  Synthetic Polynucleotide
gccatcttct

SEQ ID NO: 3951 - DNA, 10 bp, Artificial Sequence
  Synthetic Polynucleotide
atgtactaca

SEQ ID NO: 3952 - DNA, 10 bp, Artificial Sequence
  Synthetic Polynucleotide
cattttcatc

SEQ ID NO: 3953 - DNA, 10 bp, Artificial Sequence
  Synthetic Polynucleotide
tgtgggaggc

SEQ ID NO: 3954 - DNA, 10 bp, Artificial Sequence
  Synthetic Polynucleotide
aaaagaaaca

SEQ ID NO: 3955 - DNA, 10 bp, Artificial Sequence
  Synthetic Polynucleotide
gaatttaata

SEQ ID NO: 3956 - DNA, 10 bp, Artificial Sequence
  Synthetic Polynucleotide
agtaaatctg

SEQ ID NO: 3957 - DNA, 10 bp, Artificial Sequence
  Synthetic Polynucleotide
tcaccattat

SEQ ID NO: 3958 - DNA, 10 bp, Artificial Sequence
  Synthetic Polynucleotide
acataaacca

SEQ ID NO: 3959 - DNA, 10 bp, Artificial Sequence
  Synthetic Polynucleotide
caccagatgg

SEQ ID NO: 3960 - DNA, 10 bp, Artificial Sequence
  Synthetic Polynucleotide
acatgaacca

SEQ ID NO: 3961 - DNA, 10 bp, Artificial Sequence
  Synthetic Polynucleotide
atgatttcaa

SEQ ID NO: 3962 - DNA, 10 bp, Artificial Sequence
  Synthetic Polynucleotide
gtgtgcctct

SEQ ID NO: 3963 - DNA, 10 bp, Artificial Sequence
  Synthetic Polynucleotide
atgatggatg

SEQ ID NO: 3964 - DNA, 10 bp, Artificial Sequence
  Synthetic Polynucleotide
accagaaaat

SEQ ID NO: 3965 - DNA, 10 bp, Artificial Sequence
  Synthetic Polynucleotide
acaacgaaca

SEQ ID NO: 3966 - DNA, 10 bp, Artificial Sequence
  Synthetic Polynucleotide
gctttcatct

SEQ ID NO: 3967 - DNA, 10 bp, Artificial Sequence
  Synthetic Polynucleotide
accaaaccat

SEQ ID NO: 3968 - DNA, 10 bp, Artificial Sequence
  Synthetic Polynucleotide
aagctccata

SEQ ID NO: 3969 - DNA, 10 bp, Artificial Sequence
  Synthetic Polynucleotide
ctgctgtgaa

SEQ ID NO: 3970 - DNA, 10 bp, Artificial Sequence
  Synthetic Polynucleotide
cacaaagtac

SEQ ID NO: 3971 - DNA, 10 bp, Artificial Sequence
  Synthetic Polynucleotide
ttaaaatcat

SEQ ID NO: 3972 - DNA, 10 bp, Artificial Sequence
  Synthetic Polynucleotide
tggaatggtt

SEQ ID NO: 3973 - DNA, 10 bp, Artificial Sequence
  Synthetic Polynucleotide
tgtgtacaaa

SEQ ID NO: 3974 - DNA, 10 bp, Artificial Sequence
  Synthetic Polynucleotide
tgcatagaaa

SEQ ID NO: 3975 - DNA, 10 bp, Artificial Sequence
  Synthetic Polynucleotide
gggaataaca

SEQ ID NO: 3976 - DNA, 10 bp, Artificial Sequence
  Synthetic Polynucleotide
ctgtcgaatt

SEQ ID NO: 3977 - DNA, 10 bp, Artificial Sequence
  Synthetic Polynucleotide
ttgagaatgc

SEQ ID NO: 3978 - DNA, 10 bp, Artificial Sequence
  Synthetic Polynucleotide
tgtcatcaac

SEQ ID NO: 3979 - DNA, 10 bp, Artificial Sequence
  Synthetic Polynucleotide
aagatgatga

SEQ ID NO: 3980 - DNA, 10 bp, Artificial Sequence
  Synthetic Polynucleotide
cttccaccac

SEQ ID NO: 3981 - DNA, 10 bp, Artificial Sequence
  Synthetic Polynucleotide
aagctcgtta

SEQ ID NO: 3982 - DNA, 10 bp, Artificial Sequence
  Synthetic Polynucleotide
caccagatcg

SEQ ID NO: 3983 - DNA, 10 bp, Artificial Sequence
  Synthetic Polynucleotide
aaacacgctt

SEQ ID NO: 3984 - DNA, 10 bp, Artificial Sequence
  Synthetic Polynucleotide
attttatttt

SEQ ID NO: 3985 - DNA, 10 bp, Artificial Sequence
  Synthetic Polynucleotide
aaaataatat

SEQ ID NO: 3986 - DNA, 10 bp, Artificial Sequence
  Synthetic Polynucleotide
agtagttcca

SEQ ID NO: 3987 - DNA, 10 bp, Artificial Sequence
  Synthetic Polynucleotide
gaaaatgaaa

SEQ ID NO: 3988 - DNA, 10 bp, Artificial Sequence
  Synthetic Polynucleotide
aaataattat

SEQ ID NO: 3989 - DNA, 10 bp, Artificial Sequence
  Synthetic Polynucleotide
aatataaatc

SEQ ID NO: 3990 - DNA, 10 bp, Artificial Sequence
  Synthetic Polynucleotide
catcattgaa

SEQ ID NO: 3991 - DNA, 10 bp, Artificial Sequence
  Synthetic Polynucleotide
tacttaatct

SEQ ID NO: 3992 - DNA, 10 bp, Artificial Sequence
  Synthetic Polynucleotide
tgaataattg

SEQ ID NO: 3993 - DNA, 10 bp, Artificial Sequence
  Synthetic Polynucleotide
cccactattg

SEQ ID NO: 3994 - DNA, 10 bp, Artificial Sequence
  Synthetic Polynucleotide
agcatattca

SEQ ID NO: 3995 - DNA, 10 bp, Artificial Sequence
  Synthetic Polynucleotide
atgttatcaa

SEQ ID NO: 3996 - DNA, 10 bp, Artificial Sequence
  Synthetic Polynucleotide
aaatattcat

SEQ ID NO: 3997 - DNA, 10 bp, Artificial Sequence
  Synthetic Polynucleotide
attaattaat

SEQ ID NO: 3998 - DNA, 10 bp, Artificial Sequence
  Synthetic Polynucleotide
atgtagtcca

SEQ ID NO: 3999 - DNA, 10 bp, Artificial Sequence
  Synthetic Polynucleotide
cacagatagt

SEQ ID NO: 4000 - DNA, 10 bp, Artificial Sequence
  Synthetic Polynucleotide
ttccatcaac

SEQ ID NO: 4001 - DNA, 10 bp, Artificial Sequence
  Synthetic Polynucleotide
tcattttaaa

SEQ ID NO: 4002 - DNA, 10 bp, Artificial Sequence
  Synthetic Polynucleotide
atcatcatct

SEQ ID NO: 4003 - DNA, 10 bp, Artificial Sequence
  Synthetic Polynucleotide
accatgagag

SEQ ID NO: 4004 - DNA, 10 bp, Artificial Sequence
  Synthetic Polynucleotide
taactcatca

SEQ ID NO: 4005 - DNA, 10 bp, Artificial Sequence
  Synthetic Polynucleotide
tagaatttga

SEQ ID NO: 4006 - DNA, 10 bp, Artificial Sequence
  Synthetic Polynucleotide
atctggtgaa

SEQ ID NO: 4007 - DNA, 10 bp, Artificial Sequence
  Synthetic Polynucleotide
tgatgtctct

SEQ ID NO: 4008 - DNA, 10 bp, Artificial Sequence
  Synthetic Polynucleotide
gaaatatctt

SEQ ID NO: 4009 - DNA, 10 bp, Artificial Sequence
  Synthetic Polynucleotide
atcatttatt

SEQ ID NO: 4010 - DNA, 10 bp, Artificial Sequence
  Synthetic Polynucleotide
ttggtcagac

SEQ ID NO: 4011 - DNA, 10 bp, Artificial Sequence
  Synthetic Polynucleotide
tgagataatc

SEQ ID NO: 4012 - DNA, 10 bp, Artificial Sequence
  Synthetic Polynucleotide
agtaagtatc

SEQ ID NO: 4013 - DNA, 10 bp, Artificial Sequence
  Synthetic Polynucleotide
tttcaatatt

SEQ ID NO: 4014 - DNA, 10 bp, Artificial Sequence
  Synthetic Polynucleotide
aatttcttca

SEQ ID NO: 4015 - DNA, 10 bp, Artificial Sequence
  Synthetic Polynucleotide
aatcatattt

SEQ ID NO: 4016 - DNA, 10 bp, Artificial Sequence
  Synthetic Polynucleotide
tgttcaattt

SEQ ID NO: 4017 - DNA, 10 bp, Artificial Sequence
  Synthetic Polynucleotide
cgtattttcc

SEQ ID NO: 4018 - DNA, 10 bp, Artificial Sequence
  Synthetic Polynucleotide
aacatcatca

SEQ ID NO: 4019 - DNA, 10 bp, Artificial Sequence
  Synthetic Polynucleotide
acgtagagag

SEQ ID NO: 4020 - DNA, 10 bp, Artificial Sequence
  Synthetic Polynucleotide
aatatgagaa

SEQ ID NO: 4021 - DNA, 10 bp, Artificial Sequence
  Synthetic Polynucleotide
aaattattga

SEQ ID NO: 4022 - DNA, 10 bp, Artificial Sequence
  Synthetic Polynucleotide
tcttcatata

SEQ ID NO: 4023 - DNA, 10 bp, Artificial Sequence
  Synthetic Polynucleotide
taaagaaaca

SEQ ID NO: 4024 - DNA, 10 bp, Artificial Sequence
  Synthetic Polynucleotide
atttagattc

SEQ ID NO: 4025 - DNA, 10 bp, Artificial Sequence
  Synthetic Polynucleotide
tggaaaggtt

SEQ ID NO: 4026 - DNA, 10 bp, Artificial Sequence
  Synthetic Polynucleotide
aacatcataa

SEQ ID NO: 4027 - DNA, 10 bp, Artificial Sequence
  Synthetic Polynucleotide
tcactatgga

SEQ ID NO: 4028 - DNA, 10 bp, Artificial Sequence
  Synthetic Polynucleotide
taatgttgtc

SEQ ID NO: 4029 - DNA, 10 bp, Artificial Sequence
  Synthetic Polynucleotide
aacatcaact

SEQ ID NO: 4030 - DNA, 10 bp, Artificial Sequence
  Synthetic Polynucleotide
ttgaaattca

SEQ ID NO: 4031 - DNA, 10 bp, Artificial Sequence
  Synthetic Polynucleotide
gacaaaagtg

SEQ ID NO: 4032 - DNA, 10 bp, Artificial Sequence
  Synthetic Polynucleotide
ccccattgta

SEQ ID NO: 4033 - DNA, 10 bp, Artificial Sequence
  Synthetic Polynucleotide
tcgtgagatg

SEQ ID NO: 4034 - DNA, 10 bp, Artificial Sequence
  Synthetic Polynucleotide
acatccaatt

SEQ ID NO: 4035 - DNA, 10 bp, Artificial Sequence
  Synthetic Polynucleotide
caagactccc

SEQ ID NO: 4036 - DNA, 10 bp, Artificial Sequence
  Synthetic Polynucleotide
ttaataatat

SEQ ID NO: 4037 - DNA, 10 bp, Artificial Sequence
  Synthetic Polynucleotide
tagctaatat

SEQ ID NO: 4038 - DNA, 10 bp, Artificial Sequence
  Synthetic Polynucleotide
catcatattg

SEQ ID NO: 4039 - DNA, 10 bp, Artificial Sequence
  Synthetic Polynucleotide
agattttatg

SEQ ID NO: 4040 - DNA, 10 bp, Artificial Sequence
  Synthetic Polynucleotide
cttcattatc

SEQ ID NO: 4041 - DNA, 10 bp, Artificial Sequence
  Synthetic Polynucleotide
catcatgcta

SEQ ID NO: 4042 - DNA, 10 bp, Artificial Sequence
  Synthetic Polynucleotide
ccatcctgcc

SEQ ID NO: 4043 - DNA, 10 bp, Artificial Sequence
  Synthetic Polynucleotide
atatatgtct

SEQ ID NO: 4044 - DNA, 10 bp, Artificial Sequence
  Synthetic Polynucleotide
catcatcaat

SEQ ID NO: 4045 - DNA, 10 bp, Artificial Sequence
  Synthetic Polynucleotide
ctataaagct

SEQ ID NO: 4046 - DNA, 10 bp, Artificial Sequence
  Synthetic Polynucleotide
cagcggagac

SEQ ID NO: 4047 - DNA, 10 bp, Artificial Sequence
  Synthetic Polynucleotide
actttggtca

SEQ ID NO: 4048 - DNA, 10 bp, Artificial Sequence
  Synthetic Polynucleotide
tgaattatct

SEQ ID NO: 4049 - DNA, 10 bp, Artificial Sequence
  Synthetic Polynucleotide
ttaatgaaat

SEQ ID NO: 4050 - DNA, 10 bp, Artificial Sequence
  Synthetic Polynucleotide
ccccgacgat

SEQ ID NO: 4051 - DNA, 10 bp, Artificial Sequence
  Synthetic Polynucleotide
tttacaattg

SEQ ID NO: 4052 - DNA, 10 bp, Artificial Sequence
  Synthetic Polynucleotide
cttctatttt

SEQ ID NO: 4053 - DNA, 10 bp, Artificial Sequence
  Synthetic Polynucleotide
aatttaatca

SEQ ID NO: 4054 - DNA, 10 bp, Artificial Sequence
  Synthetic Polynucleotide
gatatccttc

SEQ ID NO: 4055 - DNA, 10 bp, Artificial Sequence
  Synthetic Polynucleotide
atcgttttgg

SEQ ID NO: 4056 - DNA, 10 bp, Artificial Sequence
  Synthetic Polynucleotide
tgttattctc

SEQ ID NO: 4057 - DNA, 10 bp, Artificial Sequence
  Synthetic Polynucleotide
gctcattgac

SEQ ID NO: 4058 - DNA, 10 bp, Artificial Sequence
  Synthetic Polynucleotide
ttttgtccat

SEQ ID NO: 4059 - DNA, 10 bp, Artificial Sequence
  Synthetic Polynucleotide
aatatgttat

SEQ ID NO: 4060 - DNA, 10 bp, Artificial Sequence
  Synthetic Polynucleotide
tcatcatttc

SEQ ID NO: 4061 - DNA, 10 bp, Artificial Sequence
  Synthetic Polynucleotide
tcacatgttg

SEQ ID NO: 4062 - DNA, 10 bp, Artificial Sequence
  Synthetic Polynucleotide
agataggcgc

SEQ ID NO: 4063 - DNA, 10 bp, Artificial Sequence
  Synthetic Polynucleotide
caattttaag

SEQ ID NO: 4064 - DNA, 10 bp, Artificial Sequence
  Synthetic Polynucleotide
ttcgaagtga

SEQ ID NO: 4065 - DNA, 10 bp, Artificial Sequence
  Synthetic Polynucleotide
tgccacccct

SEQ ID NO: 4066 - DNA, 10 bp, Artificial Sequence
  Synthetic Polynucleotide
taattctttt

SEQ ID NO: 4067 - DNA, 10 bp, Artificial Sequence
  Synthetic Polynucleotide
ttttatcaaa

SEQ ID NO: 4068 - DNA, 10 bp, Artificial Sequence
  Synthetic Polynucleotide
accaactaag

SEQ ID NO: 4069 - DNA, 10 bp, Artificial Sequence
  Synthetic Polynucleotide
atccatacga

SEQ ID NO: 4070 - DNA, 10 bp, Artificial Sequence
  Synthetic Polynucleotide
tagccttaag

SEQ ID NO: 4071 - DNA, 10 bp, Artificial Sequence
  Synthetic Polynucleotide
ttgctaagaa

SEQ ID NO: 4072 - DNA, 10 bp, Artificial Sequence
  Synthetic Polynucleotide
atcaatagag

SEQ ID NO: 4073 - DNA, 10 bp, Artificial Sequence
  Synthetic Polynucleotide
tagattacta

SEQ ID NO: 4074 - DNA, 10 bp, Artificial Sequence
  Synthetic Polynucleotide
aggcaattgg

SEQ ID NO: 4075 - DNA, 10 bp, Artificial Sequence
  Synthetic Polynucleotide
ttcatattat

SEQ ID NO: 4076 - DNA, 10 bp, Artificial Sequence
  Synthetic Polynucleotide
taccctctac

SEQ ID NO: 4077 - DNA, 10 bp, Artificial Sequence
  Synthetic Polynucleotide
gttggaaatc

SEQ ID NO: 4078 - DNA, 10 bp, Artificial Sequence
  Synthetic Polynucleotide
ggtgaaaggc

SEQ ID NO: 4079 - DNA, 10 bp, Artificial Sequence
  Synthetic Polynucleotide
ttcgtccatt

SEQ ID NO: 4080 - DNA, 10 bp, Artificial Sequence
  Synthetic Polynucleotide
ctgaaagttt

SEQ ID NO: 4081 - DNA, 10 bp, Artificial Sequence
  Synthetic Polynucleotide
tcgtgaaagc

SEQ ID NO: 4082 - DNA, 10 bp, Artificial Sequence
  Synthetic Polynucleotide
cttcttgaaa

SEQ ID NO: 4083 - DNA, 10 bp, Artificial Sequence
  Synthetic Polynucleotide
catttaaaga

SEQ ID NO: 4084 - DNA, 10 bp, Artificial Sequence
  Synthetic Polynucleotide
ggagtacgca

SEQ ID NO: 4085 - DNA, 10 bp, Artificial Sequence
  Synthetic Polynucleotide
gttcattctg

SEQ ID NO: 4086 - DNA, 10 bp, Artificial Sequence
  Synthetic Polynucleotide
tgtagtccag

SEQ ID NO: 4087 - DNA, 10 bp, Artificial Sequence
  Synthetic Polynucleotide
tttgaagaga

SEQ ID NO: 4088 - DNA, 10 bp, Artificial Sequence
  Synthetic Polynucleotide
cacgaagatg

SEQ ID NO: 4089 - DNA, 10 bp, Artificial Sequence
  Synthetic Polynucleotide
atttaaaatt

SEQ ID NO: 4090 - DNA, 10 bp, Artificial Sequence
  Synthetic Polynucleotide
tctaacgaat

SEQ ID NO: 4091 - DNA, 10 bp, Artificial Sequence
  Synthetic Polynucleotide
gataaatctt

SEQ ID NO: 4092 - DNA, 10 bp, Artificial Sequence
  Synthetic Polynucleotide
aattggtcat

SEQ ID NO: 4093 - DNA, 10 bp, Artificial Sequence
  Synthetic Polynucleotide
tagattttgt

SEQ ID NO: 4094 - DNA, 10 bp, Artificial Sequence
  Synthetic Polynucleotide
gtcatattca

SEQ ID NO: 4095 - DNA, 10 bp, Artificial Sequence
  Synthetic Polynucleotide
attgaaattg

SEQ ID NO: 4096 - DNA, 10 bp, Artificial Sequence
  Synthetic Polynucleotide
actgcatttg

SEQ ID NO: 4097 - DNA, 10 bp, Artificial Sequence
  Synthetic Polynucleotide
aaatgttgtc

SEQ ID NO: 4098 - DNA, 10 bp, Artificial Sequence
  Synthetic Polynucleotide
tccatcctgg

SEQ ID NO: 4099 - DNA, 10 bp, Artificial Sequence
  Synthetic Polynucleotide
tcttcattct

SEQ ID NO: 4100 - DNA, 10 bp, Artificial Sequence
  Synthetic Polynucleotide
aacttcatct

SEQ ID NO: 4101 - DNA, 10 bp, Artificial Sequence
  Synthetic Polynucleotide
gaaatctgaa

SEQ ID NO: 4102 - DNA, 10 bp, Artificial Sequence
  Synthetic Polynucleotide
ttgcattgag

SEQ ID NO: 4103 - DNA, 10 bp, Artificial Sequence
  Synthetic Polynucleotide
gtctatttct

SEQ ID NO: 4104 - DNA, 10 bp, Artificial Sequence
  Synthetic Polynucleotide
ctaccacatg

SEQ ID NO: 4105 - DNA, 10 bp, Artificial Sequence
  Synthetic Polynucleotide
taatgttgtt

SEQ ID NO: 4106 - DNA, 10 bp, Artificial Sequence
  Synthetic Polynucleotide
aatgttttcg

SEQ ID NO: 4107 - DNA, 10 bp, Artificial Sequence
  Synthetic Polynucleotide
attcagctta

SEQ ID NO: 4108 - DNA, 10 bp, Artificial Sequence
  Synthetic Polynucleotide
aagtcatcat

SEQ ID NO: 4109 - DNA, 10 bp, Artificial Sequence
  Synthetic Polynucleotide
ccagaacatt

SEQ ID NO: 4110 - DNA, 10 bp, Artificial Sequence
  Synthetic Polynucleotide
tggcaattca

SEQ ID NO: 4111 - DNA, 10 bp, Artificial Sequence
  Synthetic Polynucleotide
acagaatcaa

SEQ ID NO: 4112 - DNA, 10 bp, Artificial Sequence
  Synthetic Polynucleotide
atcatcatca

SEQ ID NO: 4113 - DNA, 10 bp, Artificial Sequence
  Synthetic Polynucleotide
tcaactggaa

SEQ ID NO: 4114 - DNA, 10 bp, Artificial Sequence
  Synthetic Polynucleotide
gcattaatcc

SEQ ID NO: 4115 - DNA, 10 bp, Artificial Sequence
  Synthetic Polynucleotide
ctgaaacact

SEQ ID NO: 4116 - DNA, 10 bp, Artificial Sequence
  Synthetic Polynucleotide
ctgacttaat

SEQ ID NO: 4117 - DNA, 10 bp, Artificial Sequence
  Synthetic Polynucleotide
gtatcttacg

SEQ ID NO: 4118 - DNA, 10 bp, Artificial Sequence
  Synthetic Polynucleotide
cttttaagtt

SEQ ID NO: 4119 - DNA, 10 bp, Artificial Sequence
  Synthetic Polynucleotide
gaagattatt

SEQ ID NO: 4120 - DNA, 10 bp, Artificial Sequence
  Synthetic Polynucleotide
aaaatttgat

SEQ ID NO: 4121 - DNA, 10 bp, Artificial Sequence
  Synthetic Polynucleotide
tcaagcgatg

SEQ ID NO: 4122 - DNA, 10 bp, Artificial Sequence
  Synthetic Polynucleotide
atcgtaaatg

SEQ ID NO: 4123 - DNA, 10 bp, Artificial Sequence
  Synthetic Polynucleotide
gactccatct

SEQ ID NO: 4124 - DNA, 10 bp, Artificial Sequence
  Synthetic Polynucleotide
ctccatttcg

SEQ ID NO: 4125 - DNA, 10 bp, Artificial Sequence
  Synthetic Polynucleotide
aatggtatcc

SEQ ID NO: 4126 - DNA, 10 bp, Artificial Sequence
  Synthetic Polynucleotide
aattcatcca

SEQ ID NO: 4127 - DNA, 10 bp, Artificial Sequence
  Synthetic Polynucleotide
atatcctgtt

SEQ ID NO: 4128 - DNA, 10 bp, Artificial Sequence
  Synthetic Polynucleotide
atattaacaa

SEQ ID NO: 4129 - DNA, 10 bp, Artificial Sequence
  Synthetic Polynucleotide
gtaagtgtat

SEQ ID NO: 4130 - DNA, 10 bp, Artificial Sequence
  Synthetic Polynucleotide
cttgaaagcg

SEQ ID NO: 4131 - DNA, 10 bp, Artificial Sequence
  Synthetic Polynucleotide
tttcttcatc

SEQ ID NO: 4132 - DNA, 10 bp, Artificial Sequence
  Synthetic Polynucleotide
ggagatgtaa

SEQ ID NO: 4133 - DNA, 10 bp, Artificial Sequence
  Synthetic Polynucleotide
tgagaacgtc

SEQ ID NO: 4134 - DNA, 10 bp, Artificial Sequence
  Synthetic Polynucleotide
aagatcagag

SEQ ID NO: 4135 - DNA, 10 bp, Artificial Sequence
  Synthetic Polynucleotide
cggcgaggtc

SEQ ID NO: 4136 - DNA, 10 bp, Artificial Sequence
  Synthetic Polynucleotide
gacattttgt

SEQ ID NO: 4137 - DNA, 10 bp, Artificial Sequence
  Synthetic Polynucleotide
atgtccttga

SEQ ID NO: 4138 - DNA, 10 bp, Artificial Sequence
  Synthetic Polynucleotide
taatcaagct

SEQ ID NO: 4139 - DNA, 10 bp, Artificial Sequence
  Synthetic Polynucleotide
ttagttagcg

SEQ ID NO: 4140 - DNA, 10 bp, Artificial Sequence
  Synthetic Polynucleotide
tcattgatta

SEQ ID NO: 4141 - DNA, 10 bp, Artificial Sequence
  Synthetic Polynucleotide
cctcatcatc

SEQ ID NO: 4142 - DNA, 10 bp, Artificial Sequence
  Synthetic Polynucleotide
gcattataat

SEQ ID NO: 4143 - DNA, 10 bp, Artificial Sequence
  Synthetic Polynucleotide
atgatcaggg

SEQ ID NO: 4144 - DNA, 10 bp, Artificial Sequence
  Synthetic Polynucleotide
ttcaatcccg

SEQ ID NO: 4145 - DNA, 10 bp, Artificial Sequence
  Synthetic Polynucleotide
cagacgtaga

SEQ ID NO: 4146 - DNA, 10 bp, Artificial Sequence
  Synthetic Polynucleotide
tggattagtc

SEQ ID NO: 4147 - DNA, 10 bp, Artificial Sequence
  Synthetic Polynucleotide
tcatattgtg

SEQ ID NO: 4148 - DNA, 10 bp, Artificial Sequence
  Synthetic Polynucleotide
atcaattcat

SEQ ID NO: 4149 - DNA, 10 bp, Artificial Sequence
  Synthetic Polynucleotide
ggtacagtat

SEQ ID NO: 4150 - DNA, 10 bp, Artificial Sequence
  Synthetic Polynucleotide
ctgtgactct

SEQ ID NO: 4151 - DNA, 10 bp, Artificial Sequence
  Synthetic Polynucleotide
tgcttcagct

SEQ ID NO: 4152 - DNA, 10 bp, Artificial Sequence
  Synthetic Polynucleotide
catcagatcg

SEQ ID NO: 4153 - DNA, 10 bp, Artificial Sequence
  Synthetic Polynucleotide
agatgtgcat

SEQ ID NO: 4154 - DNA, 10 bp, Artificial Sequence
  Synthetic Polynucleotide
ccatctgctg

SEQ ID NO: 4155 - DNA, 10 bp, Artificial Sequence
  Synthetic Polynucleotide
aacttcttca

SEQ ID NO: 4156 - DNA, 10 bp, Artificial Sequence
  Synthetic Polynucleotide
tcgattttga

SEQ ID NO: 4157 - DNA, 10 bp, Artificial Sequence
  Synthetic Polynucleotide
ccgatgaaca

SEQ ID NO: 4158 - DNA, 10 bp, Artificial Sequence
  Synthetic Polynucleotide
cttttctatt

SEQ ID NO: 4159 - DNA, 10 bp, Artificial Sequence
  Synthetic Polynucleotide
taacttaacc

SEQ ID NO: 4160 - DNA, 10 bp, Artificial Sequence
  Synthetic Polynucleotide
gattttagac

SEQ ID NO: 4161 - DNA, 10 bp, Artificial Sequence
  Synthetic Polynucleotide
cgttcaattg

SEQ ID NO: 4162 - DNA, 10 bp, Artificial Sequence
  Synthetic Polynucleotide
aaatttgcaa

SEQ ID NO: 4163 - DNA, 10 bp, Artificial Sequence
  Synthetic Polynucleotide
aatttcttga

SEQ ID NO: 4164 - DNA, 10 bp, Artificial Sequence
  Synthetic Polynucleotide
ctcagagagg

SEQ ID NO: 4165 - DNA, 10 bp, Artificial Sequence
  Synthetic Polynucleotide
tcatcatact

SEQ ID NO: 4166 - DNA, 10 bp, Artificial Sequence
  Synthetic Polynucleotide
tcgaacacat

SEQ ID NO: 4167 - DNA, 10 bp, Artificial Sequence
  Synthetic Polynucleotide
ggctagtttc

SEQ ID NO: 4168 - DNA, 10 bp, Artificial Sequence
  Synthetic Polynucleotide
tttattatat

SEQ ID NO: 4169 - DNA, 10 bp, Artificial Sequence
  Synthetic Polynucleotide
aacaaatcaa

SEQ ID NO: 4170 - DNA, 10 bp, Artificial Sequence
  Synthetic Polynucleotide
tcattagtta

SEQ ID NO: 4171 - DNA, 10 bp, Artificial Sequence
  Synthetic Polynucleotide
agaacgtgac

SEQ ID NO: 4172 - DNA, 10 bp, Artificial Sequence
  Synthetic Polynucleotide
gatatcagag

SEQ ID NO: 4173 - DNA, 10 bp, Artificial Sequence
  Synthetic Polynucleotide
ctgggtcagg

SEQ ID NO: 4174 - DNA, 10 bp, Artificial Sequence
  Synthetic Polynucleotide
taagctcaac

SEQ ID NO: 4175 - DNA, 10 bp, Artificial Sequence
  Synthetic Polynucleotide
tatcactcat

SEQ ID NO: 4176 - DNA, 10 bp, Artificial Sequence
  Synthetic Polynucleotide
attaataatt

SEQ ID NO: 4177 - DNA, 10 bp, Artificial Sequence
  Synthetic Polynucleotide
tgggtcatag

SEQ ID NO: 4178 - DNA, 10 bp, Artificial Sequence
  Synthetic Polynucleotide
ccggtcattc

SEQ ID NO: 4179 - DNA, 10 bp, Artificial Sequence
  Synthetic Polynucleotide
ttcaaccgtt

SEQ ID NO: 4180 - DNA, 10 bp, Artificial Sequence
  Synthetic Polynucleotide
acctcaagat

SEQ ID NO: 4181 - DNA, 10 bp, Artificial Sequence
  Synthetic Polynucleotide
ctgttcaaac

SEQ ID NO: 4182 - DNA, 10 bp, Artificial Sequence
  Synthetic Polynucleotide
actttgattt

SEQ ID NO: 4183 - DNA, 10 bp, Artificial Sequence
  Synthetic Polynucleotide
gtgcttcatt

SEQ ID NO: 4184 - DNA, 10 bp, Artificial Sequence
  Synthetic Polynucleotide
ataaacaatg

SEQ ID NO: 4185 - DNA, 10 bp, Artificial Sequence
  Synthetic Polynucleotide
gatgtaggag

SEQ ID NO: 4186 - DNA, 10 bp, Artificial Sequence
  Synthetic Polynucleotide
tggtgaatca

SEQ ID NO: 4187 - DNA, 10 bp, Artificial Sequence
  Synthetic Polynucleotide
gtagccgagt

SEQ ID NO: 4188 - DNA, 10 bp, Artificial Sequence
  Synthetic Polynucleotide
atagactcga

SEQ ID NO: 4189 - DNA, 10 bp, Artificial Sequence
  Synthetic Polynucleotide
gaaaagcatc

SEQ ID NO: 4190 - DNA, 10 bp, Artificial Sequence
  Synthetic Polynucleotide
agctcgacaa

SEQ ID NO: 4191 - DNA, 10 bp, Artificial Sequence
  Synthetic Polynucleotide
aatggtgagt

SEQ ID NO: 4192 - DNA, 10 bp, Artificial Sequence
  Synthetic Polynucleotide
catatcaggc

SEQ ID NO: 4193 - DNA, 10 bp, Artificial Sequence
  Synthetic Polynucleotide
tataaggtcg

SEQ ID NO: 4194 - DNA, 10 bp, Artificial Sequence
  Synthetic Polynucleotide
tctaccgaaa

SEQ ID NO: 4195 - DNA, 10 bp, Artificial Sequence
  Synthetic Polynucleotide
taatctatct

SEQ ID NO: 4196 - DNA, 10 bp, Artificial Sequence
  Synthetic Polynucleotide
agataaaagt

SEQ ID NO: 4197 - DNA, 10 bp, Artificial Sequence
  Synthetic Polynucleotide
tccaacctgt

SEQ ID NO: 4198 - DNA, 10 bp, Artificial Sequence
  Synthetic Polynucleotide
gctcttgaag

SEQ ID NO: 4199 - DNA, 10 bp, Artificial Sequence
  Synthetic Polynucleotide
cccacatagc

SEQ ID NO: 4200 - DNA, 10 bp, Artificial Sequence
  Synthetic Polynucleotide
cgtcagtagc

SEQ ID NO: 4201 - DNA, 10 bp, Artificial Sequence
  Synthetic Polynucleotide
cctcatctaa

SEQ ID NO: 4202 - DNA, 10 bp, Artificial Sequence
  Synthetic Polynucleotide
agaactaccc

SEQ ID NO: 4203 - DNA, 10 bp, Artificial Sequence
  Synthetic Polynucleotide
cgacttgggt

SEQ ID NO: 4204 - DNA, 10 bp, Artificial Sequence
  Synthetic Polynucleotide
cgactttacc

SEQ ID NO: 4205 - DNA, 10 bp, Artificial Sequence
  Synthetic Polynucleotide
tagacacatt

SEQ ID NO: 4206 - DNA, 10 bp, Artificial Sequence
  Synthetic Polynucleotide
ctcttacgtt

SEQ ID NO: 4207 - DNA, 10 bp, Artificial Sequence
  Synthetic Polynucleotide
ttgaaaggtt

SEQ ID NO: 4208 - DNA, 10 bp, Artificial Sequence
  Synthetic Polynucleotide
gctctccaac

SEQ ID NO: 4209 - DNA, 10 bp, Artificial Sequence
  Synthetic Polynucleotide
cgattagtga

SEQ ID NO: 4210 - DNA, 10 bp, Artificial Sequence
  Synthetic Polynucleotide
aagaacaaga

SEQ ID NO: 4211 - DNA, 10 bp, Artificial Sequence
  Synthetic Polynucleotide
tttctctata

SEQ ID NO: 4212 - DNA, 10 bp, Artificial Sequence
  Synthetic Polynucleotide
aattaaacat

SEQ ID NO: 4213 - DNA, 10 bp, Artificial Sequence
  Synthetic Polynucleotide
tctaagaatg

SEQ ID NO: 4214 - DNA, 10 bp, Artificial Sequence
  Synthetic Polynucleotide
gatcaactcc

SEQ ID NO: 4215 - DNA, 10 bp, Artificial Sequence
  Synthetic Polynucleotide
gatcatacga

SEQ ID NO: 4216 - DNA, 10 bp, Artificial Sequence
  Synthetic Polynucleotide
atgatcaggt

SEQ ID NO: 4217 - DNA, 10 bp, Artificial Sequence
  Synthetic Polynucleotide
acctcaaacg

SEQ ID NO: 4218 - DNA, 10 bp, Artificial Sequence
  Synthetic Polynucleotide
cgtttcgacg

SEQ ID NO: 4219 - DNA, 10 bp, Artificial Sequence
  Synthetic Polynucleotide
tcattctcaa

SEQ ID NO: 4220 - DNA, 10 bp, Artificial Sequence
  Synthetic Polynucleotide
accccttcta

SEQ ID NO: 4221 - DNA, 10 bp, Artificial Sequence
  Synthetic Polynucleotide
agttatgaag

SEQ ID NO: 4222 - DNA, 10 bp, Artificial Sequence
  Synthetic Polynucleotide
tcattagcca

SEQ ID NO: 4223 - DNA, 10 bp, Artificial Sequence
  Synthetic Polynucleotide
atgtgctacg

SEQ ID NO: 4224 - DNA, 10 bp, Artificial Sequence
  Synthetic Polynucleotide
ctcatttctt

SEQ ID NO: 4225 - DNA, 10 bp, Artificial Sequence
  Synthetic Polynucleotide
gagtgctcga

SEQ ID NO: 4226 - DNA, 10 bp, Artificial Sequence
  Synthetic Polynucleotide
gttttagaag

SEQ ID NO: 4227 - DNA, 10 bp, Artificial Sequence
  Synthetic Polynucleotide
tgttttccat

SEQ ID NO: 4228 - DNA, 10 bp, Artificial Sequence
  Synthetic Polynucleotide
ggggattggg

SEQ ID NO: 4229 - DNA, 10 bp, Artificial Sequence
  Synthetic Polynucleotide
ggaaagtccc

SEQ ID NO: 4230 - DNA, 10 bp, Artificial Sequence
  Synthetic Polynucleotide
taaaagaaaa

SEQ ID NO: 4231 - DNA, 10 bp, Artificial Sequence
  Synthetic Polynucleotide
agaagcgaga

SEQ ID NO: 4232 - DNA, 10 bp, Artificial Sequence
  Synthetic Polynucleotide
gaatgaaaga

SEQ ID NO: 4233 - DNA, 10 bp, Artificial Sequence
  Synthetic Polynucleotide
ttacccatgg

SEQ ID NO: 4234 - DNA, 10 bp, Artificial Sequence
  Synthetic Polynucleotide
ggatcccgtg

SEQ ID NO: 4235 - DNA, 10 bp, Artificial Sequence
  Synthetic Polynucleotide
tattccctaa

SEQ ID NO: 4236 - DNA, 10 bp, Artificial Sequence
  Synthetic Polynucleotide
cacattggtg

SEQ ID NO: 4237 - DNA, 10 bp, Artificial Sequence
  Synthetic Polynucleotide
aaatatgcat

SEQ ID NO: 4238 - DNA, 10 bp, Artificial Sequence
  Synthetic Polynucleotide
acaggagcag

SEQ ID NO: 4239 - DNA, 10 bp, Artificial Sequence
  Synthetic Polynucleotide
ccaaagagag

SEQ ID NO: 4240 - DNA, 10 bp, Artificial Sequence
  Synthetic Polynucleotide
aattggatga

SEQ ID NO: 4241 - DNA, 10 bp, Artificial Sequence
  Synthetic Polynucleotide
gttaatactg

SEQ ID NO: 4242 - DNA, 10 bp, Artificial Sequence
  Synthetic Polynucleotide
ggccagcccc

SEQ ID NO: 4243 - DNA, 10 bp, Artificial Sequence
  Synthetic Polynucleotide
accctctcct

SEQ ID NO: 4244 - DNA, 10 bp, Artificial Sequence
  Synthetic Polynucleotide
gaaaggaaaa

SEQ ID NO: 4245 - DNA, 10 bp, Artificial Sequence
  Synthetic Polynucleotide
aaaagggtgg

SEQ ID NO: 4246 - DNA, 10 bp, Artificial Sequence
  Synthetic Polynucleotide
ccctggaaca

SEQ ID NO: 4247 - DNA, 10 bp, Artificial Sequence
  Synthetic Polynucleotide
tgtaatttat

SEQ ID NO: 4248 - DNA, 10 bp, Artificial Sequence
  Synthetic Polynucleotide
atatggatga

SEQ ID NO: 4249 - DNA, 10 bp, Artificial Sequence
  Synthetic Polynucleotide
tctggggttt

SEQ ID NO: 4250 - DNA, 10 bp, Artificial Sequence
  Synthetic Polynucleotide
tccttataat

SEQ ID NO: 4251 - DNA, 10 bp, Artificial Sequence
  Synthetic Polynucleotide
gtaaaacatg

SEQ ID NO: 4252 - DNA, 10 bp, Artificial Sequence
  Synthetic Polynucleotide
ttagaagaaa

SEQ ID NO: 4253 - DNA, 10 bp, Artificial Sequence
  Synthetic Polynucleotide
cagcatttgt

SEQ ID NO: 4254 - DNA, 10 bp, Artificial Sequence
  Synthetic Polynucleotide
gttttgcagg

SEQ ID NO: 4255 - DNA, 10 bp, Artificial Sequence
  Synthetic Polynucleotide
acaatcatcc

SEQ ID NO: 4256 - DNA, 10 bp, Artificial Sequence
  Synthetic Polynucleotide
taattggaaa

SEQ ID NO: 4257 - DNA, 10 bp, Artificial Sequence
  Synthetic Polynucleotide
tctactattc

SEQ ID NO: 4258 - DNA, 10 bp, Artificial Sequence
  Synthetic Polynucleotide
ataggaggaa

SEQ ID NO: 4259 - DNA, 10 bp, Artificial Sequence
  Synthetic Polynucleotide
ttagctgtag

SEQ ID NO: 4260 - DNA, 10 bp, Artificial Sequence
  Synthetic Polynucleotide
taattgcacc

SEQ ID NO: 4261 - DNA, 10 bp, Artificial Sequence
  Synthetic Polynucleotide
tgtactgtgt

SEQ ID NO: 4262 - DNA, 10 bp, Artificial Sequence
  Synthetic Polynucleotide
ttaaaacaaa

SEQ ID NO: 4263 - DNA, 10 bp, Artificial Sequence
  Synthetic Polynucleotide
acagttttgt

SEQ ID NO: 4264 - DNA, 10 bp, Artificial Sequence
  Synthetic Polynucleotide
cagctgccca

SEQ ID NO: 4265 - DNA, 10 bp, Artificial Sequence
  Synthetic Polynucleotide
ctttgcagta

SEQ ID NO: 4266 - DNA, 10 bp, Artificial Sequence
  Synthetic Polynucleotide
aaagggtgat

SEQ ID NO: 4267 - DNA, 10 bp, Artificial Sequence
  Synthetic Polynucleotide
ctcgtctaaa

SEQ ID NO: 4268 - DNA, 10 bp, Artificial Sequence
  Synthetic Polynucleotide
cacttagaat

SEQ ID NO: 4269 - DNA, 10 bp, Artificial Sequence
  Synthetic Polynucleotide
atcttttata

SEQ ID NO: 4270 - DNA, 10 bp, Artificial Sequence
  Synthetic Polynucleotide
catgctaaac

SEQ ID NO: 4271 - DNA, 10 bp, Artificial Sequence
  Synthetic Polynucleotide
gtgttagttt

SEQ ID NO: 4272 - DNA, 10 bp, Artificial Sequence
  Synthetic Polynucleotide
tggcagatga

SEQ ID NO: 4273 - DNA, 10 bp, Artificial Sequence
  Synthetic Polynucleotide
aggaactcat

SEQ ID NO: 4274 - DNA, 10 bp, Artificial Sequence
  Synthetic Polynucleotide
aaagttgtac

SEQ ID NO: 4275 - DNA, 10 bp, Artificial Sequence
  Synthetic Polynucleotide
gcctggacgg

SEQ ID NO: 4276 - DNA, 10 bp, Artificial Sequence
  Synthetic Polynucleotide
ttgggaagag

SEQ ID NO: 4277 - DNA, 10 bp, Artificial Sequence
  Synthetic Polynucleotide
aggaaagaag

SEQ ID NO: 4278 - DNA, 10 bp, Artificial Sequence
  Synthetic Polynucleotide
tggaaagaga

SEQ ID NO: 4279 - DNA, 10 bp, Artificial Sequence
  Synthetic Polynucleotide
tctttgttga

SEQ ID NO: 4280 - DNA, 10 bp, Artificial Sequence
  Synthetic Polynucleotide
atcaaagata

SEQ ID NO: 4281 - DNA, 10 bp, Artificial Sequence
  Synthetic Polynucleotide
tgttgtacat

SEQ ID NO: 4282 - DNA, 10 bp, Artificial Sequence
  Synthetic Polynucleotide
acaatcaagt

SEQ ID NO: 4283 - DNA, 10 bp, Artificial Sequence
  Synthetic Polynucleotide
tgaacttgag

SEQ ID NO: 4284 - DNA, 10 bp, Artificial Sequence
  Synthetic Polynucleotide
gaggattaag

SEQ ID NO: 4285 - DNA, 10 bp, Artificial Sequence
  Synthetic Polynucleotide
tgtagtattg

SEQ ID NO: 4286 - DNA, 10 bp, Artificial Sequence
  Synthetic Polynucleotide
atatgatgca

SEQ ID NO: 4287 - DNA, 10 bp, Artificial Sequence
  Synthetic Polynucleotide
tgatgcaatg

SEQ ID NO: 4288 - DNA, 10 bp, Artificial Sequence
  Synthetic Polynucleotide
taaaacttct

SEQ ID NO: 4289 - DNA, 10 bp, Artificial Sequence
  Synthetic Polynucleotide
cataatattt

SEQ ID NO: 4290 - DNA, 10 bp, Artificial Sequence
  Synthetic Polynucleotide
taaaattagc

SEQ ID NO: 4291 - DNA, 10 bp, Artificial Sequence
  Synthetic Polynucleotide
tgctcatcac

SEQ ID NO: 4292 - DNA, 10 bp, Artificial Sequence
  Synthetic Polynucleotide
aaaccagcaa

SEQ ID NO: 4293 - DNA, 10 bp, Artificial Sequence
  Synthetic Polynucleotide
cttcatcttg

SEQ ID NO: 4294 - DNA, 10 bp, Artificial Sequence
  Synthetic Polynucleotide
cagcatcaag

SEQ ID NO: 4295 - DNA, 10 bp, Artificial Sequence
  Synthetic Polynucleotide
atatagaaat

SEQ ID NO: 4296 - DNA, 10 bp, Artificial Sequence
  Synthetic Polynucleotide
cgaggaaagg

SEQ ID NO: 4297 - DNA, 10 bp, Artificial Sequence
  Synthetic Polynucleotide
gcttcatcaa

SEQ ID NO: 4298 - DNA, 10 bp, Artificial Sequence
  Synthetic Polynucleotide
tataagaaag

SEQ ID NO: 4299 - DNA, 10 bp, Artificial Sequence
  Synthetic Polynucleotide
ttccgctttt

SEQ ID NO: 4300 - DNA, 10 bp, Artificial Sequence
  Synthetic Polynucleotide
gaaacagaaa

SEQ ID NO: 4301 - DNA, 10 bp, Artificial Sequence
  Synthetic Polynucleotide
cttcttcatc

SEQ ID NO: 4302 - DNA, 10 bp, Artificial Sequence
  Synthetic Polynucleotide
aaaagatatg

SEQ ID NO: 4303 - DNA, 10 bp, Artificial Sequence
  Synthetic Polynucleotide
cgccgccgcc

SEQ ID NO: 4304 - DNA, 10 bp, Artificial Sequence
  Synthetic Polynucleotide
cagatcgagg

SEQ ID NO: 4305 - DNA, 10 bp, Artificial Sequence
  Synthetic Polynucleotide
ttttaatttc

SEQ ID NO: 4306 - DNA, 10 bp, Artificial Sequence
  Synthetic Polynucleotide
attgaaatta

SEQ ID NO: 4307 - DNA, 10 bp, Artificial Sequence
  Synthetic Polynucleotide
gaacgggtcg

SEQ ID NO: 4308 - DNA, 10 bp, Artificial Sequence
  Synthetic Polynucleotide
ggatctcgga

SEQ ID NO: 4309 - DNA, 10 bp, Artificial Sequence
  Synthetic Polynucleotide
aagaagctga

SEQ ID NO: 4310 - DNA, 10 bp, Artificial Sequence
  Synthetic Polynucleotide
aaaatcatca

SEQ ID NO: 4311 - DNA, 10 bp, Artificial Sequence
  Synthetic Polynucleotide
agaaattgaa

SEQ ID NO: 4312 - DNA, 10 bp, Artificial Sequence
  Synthetic Polynucleotide
cttcgccgcg

SEQ ID NO: 4313 - DNA, 10 bp, Artificial Sequence
  Synthetic Polynucleotide
cgacgaagtg

SEQ ID NO: 4314 - DNA, 10 bp, Artificial Sequence
  Synthetic Polynucleotide
taacttttaa

SEQ ID NO: 4315 - DNA, 10 bp, Artificial Sequence
  Synthetic Polynucleotide
aaaataaaga

SEQ ID NO: 4316 - DNA, 10 bp, Artificial Sequence
  Synthetic Polynucleotide
atcatcatca

SEQ ID NO: 4317 - DNA, 10 bp, Artificial Sequence
  Synthetic Polynucleotide
aaaagaaaac

SEQ ID NO: 4318 - DNA, 10 bp, Artificial Sequence
  Synthetic Polynucleotide
tgtcgccgtc

SEQ ID NO: 4319 - DNA, 10 bp, Artificial Sequence
  Synthetic Polynucleotide
ggcatcaccg

SEQ ID NO: 4320 - DNA, 10 bp, Artificial Sequence
  Synthetic Polynucleotide
tgctgctcga

SEQ ID NO: 4321 - DNA, 10 bp, Artificial Sequence
  Synthetic Polynucleotide
cgaaaatttc

SEQ ID NO: 4322 - DNA, 10 bp, Artificial Sequence
  Synthetic Polynucleotide
attgtcttat

SEQ ID NO: 4323 - DNA, 10 bp, Artificial Sequence
  Synthetic Polynucleotide
gcagaacaag

SEQ ID NO: 4324 - DNA, 10 bp, Artificial Sequence
  Synthetic Polynucleotide
tcaaaatcaa

SEQ ID NO: 4325 - DNA, 10 bp, Artificial Sequence
  Synthetic Polynucleotide
aaatatgatt

SEQ ID NO: 4326 - DNA, 10 bp, Artificial Sequence
  Synthetic Polynucleotide
ccgctccagc

SEQ ID NO: 4327 - DNA, 10 bp, Artificial Sequence
  Synthetic Polynucleotide
acgccaacag

SEQ ID NO: 4328 - DNA, 10 bp, Artificial Sequence
  Synthetic Polynucleotide
taagtctttt

SEQ ID NO: 4329 - DNA, 10 bp, Artificial Sequence
  Synthetic Polynucleotide
aaaatacaaa

SEQ ID NO: 4330 - DNA, 10 bp, Artificial Sequence
  Synthetic Polynucleotide
cagccactcg

SEQ ID NO: 4331 - DNA, 10 bp, Artificial Sequence
  Synthetic Polynucleotide
gccgccaagg

SEQ ID NO: 4332 - DNA, 10 bp, Artificial Sequence
  Synthetic Polynucleotide
tcatcccctt

SEQ ID NO: 4333 - DNA, 10 bp, Artificial Sequence
  Synthetic Polynucleotide
attatttcat

SEQ ID NO: 4334 - DNA, 10 bp, Artificial Sequence
  Synthetic Polynucleotide
tatttgtcag

SEQ ID NO: 4335 - DNA, 10 bp, Artificial Sequence
  Synthetic Polynucleotide
gaaagcaata

SEQ ID NO: 4336 - DNA, 10 bp, Artificial Sequence
  Synthetic Polynucleotide
gcgtatcagc

SEQ ID NO: 4337 - DNA, 10 bp, Artificial Sequence
  Synthetic Polynucleotide
caacaacgtt

SEQ ID NO: 4338 - DNA, 10 bp, Artificial Sequence
  Synthetic Polynucleotide
tcctgagcct

SEQ ID NO: 4339 - DNA, 10 bp, Artificial Sequence
  Synthetic Polynucleotide
ttcagggtcg

SEQ ID NO: 4340 - DNA, 10 bp, Artificial Sequence
  Synthetic Polynucleotide
agctagaaaa

SEQ ID NO: 4341 - DNA, 10 bp, Artificial Sequence
  Synthetic Polynucleotide
cttacaatac

SEQ ID NO: 4342 - DNA, 10 bp, Artificial Sequence
  Synthetic Polynucleotide
catttaaacc

SEQ ID NO: 4343 - DNA, 10 bp, Artificial Sequence
  Synthetic Polynucleotide
acctgcaaag

SEQ ID NO: 4344 - DNA, 10 bp, Artificial Sequence
  Synthetic Polynucleotide
ggcttcgggg

SEQ ID NO: 4345 - DNA, 10 bp, Artificial Sequence
  Synthetic Polynucleotide
acgcaggagg

SEQ ID NO: 4346 - DNA, 10 bp, Artificial Sequence
  Synthetic Polynucleotide
gcatgttggc

SEQ ID NO: 4347 - DNA, 10 bp, Artificial Sequence
  Synthetic Polynucleotide
gataagagag

SEQ ID NO: 4348 - DNA, 10 bp, Artificial Sequence
  Synthetic Polynucleotide
acttcttctg

SEQ ID NO: 4349 - DNA, 10 bp, Artificial Sequence
  Synthetic Polynucleotide
gtagacaccc

SEQ ID NO: 4350 - DNA, 10 bp, Artificial Sequence
  Synthetic Polynucleotide
tgcatacgtg

SEQ ID NO: 4351 - DNA, 10 bp, Artificial Sequence
  Synthetic Polynucleotide
acaggttcgg

SEQ ID NO: 4352 - DNA, 10 bp, Artificial Sequence
  Synthetic Polynucleotide
tccatgttca

SEQ ID NO: 4353 - DNA, 10 bp, Artificial Sequence
  Synthetic Polynucleotide
atgatgaaat

SEQ ID NO: 4354 - DNA, 10 bp, Artificial Sequence
  Synthetic Polynucleotide
tggaggcaca

SEQ ID NO: 4355 - DNA, 10 bp, Artificial Sequence
  Synthetic Polynucleotide
ggaagtgcgc

SEQ ID NO: 4356 - DNA, 10 bp, Artificial Sequence
  Synthetic Polynucleotide
tcggcccagt

SEQ ID NO: 4357 - DNA, 10 bp, Artificial Sequence
  Synthetic Polynucleotide
atgaccatgc

SEQ ID NO: 4358 - DNA, 10 bp, Artificial Sequence
  Synthetic Polynucleotide
tatttaggac

SEQ ID NO: 4359 - DNA, 10 bp, Artificial Sequence
  Synthetic Polynucleotide
atgatgaagt

SEQ ID NO: 4360 - DNA, 10 bp, Artificial Sequence
  Synthetic Polynucleotide
ccaccatatc

SEQ ID NO: 4361 - DNA, 10 bp, Artificial Sequence
  Synthetic Polynucleotide
gaagcgggag

SEQ ID NO: 4362 - DNA, 10 bp, Artificial Sequence
  Synthetic Polynucleotide
cattgtacct

SEQ ID NO: 4363 - DNA, 10 bp, Artificial Sequence
  Synthetic Polynucleotide
aatagggagg

SEQ ID NO: 4364 - DNA, 10 bp, Artificial Sequence
  Synthetic Polynucleotide
aacaaacgtt

SEQ ID NO: 4365 - DNA, 10 bp, Artificial Sequence
  Synthetic Polynucleotide
taggggtgcc

SEQ ID NO: 4366 - DNA, 10 bp, Artificial Sequence
  Synthetic Polynucleotide
ccccattgtt

SEQ ID NO: 4367 - DNA, 10 bp, Artificial Sequence
  Synthetic Polynucleotide
acatgaacac

SEQ ID NO: 4368 - DNA, 10 bp, Artificial Sequence
  Synthetic Polynucleotide
aggggtatga

SEQ ID NO: 4369 - DNA, 10 bp, Artificial Sequence
  Synthetic Polynucleotide
gcatcttcca

SEQ ID NO: 4370 - DNA, 10 bp, Artificial Sequence
  Synthetic Polynucleotide
gaatgaatcc

SEQ ID NO: 4371 - DNA, 10 bp, Artificial Sequence
  Synthetic Polynucleotide
acccagctcc

SEQ ID NO: 4372 - DNA, 10 bp, Artificial Sequence
  Synthetic Polynucleotide
gcggggcgat

SEQ ID NO: 4373 - DNA, 10 bp, Artificial Sequence
  Synthetic Polynucleotide
acagtgttgc

SEQ ID NO: 4374 - DNA, 10 bp, Artificial Sequence
  Synthetic Polynucleotide
gttttctact

SEQ ID NO: 4375 - DNA, 10 bp, Artificial Sequence
  Synthetic Polynucleotide
agttgcaaga

SEQ ID NO: 4376 - DNA, 10 bp, Artificial Sequence
  Synthetic Polynucleotide
caccattgtt

SEQ ID NO: 4377 - DNA, 10 bp, Artificial Sequence
  Synthetic Polynucleotide
ggtataatgt

SEQ ID NO: 4378 - DNA, 10 bp, Artificial Sequence
  Synthetic Polynucleotide
tcatgtcacc

SEQ ID NO: 4379 - DNA, 10 bp, Artificial Sequence
  Synthetic Polynucleotide
aaatggcaaa

SEQ ID NO: 4380 - DNA, 10 bp, Artificial Sequence
  Synthetic Polynucleotide
tgtgggttgg

SEQ ID NO: 4381 - DNA, 10 bp, Artificial Sequence
  Synthetic Polynucleotide
ggtccaagcc

SEQ ID NO: 4382 - DNA, 10 bp, Artificial Sequence
  Synthetic Polynucleotide
gctcgacaag

SEQ ID NO: 4383 - DNA, 10 bp, Artificial Sequence
  Synthetic Polynucleotide
gtctatcaga

SEQ ID NO: 4384 - DNA, 10 bp, Artificial Sequence
  Synthetic Polynucleotide
tggttcagaa

SEQ ID NO: 4385 - DNA, 10 bp, Artificial Sequence
  Synthetic Polynucleotide
attgtccaaa

SEQ ID NO: 4386 - DNA, 10 bp, Artificial Sequence
  Synthetic Polynucleotide
tcgtcaagaa

SEQ ID NO: 4387 - DNA, 10 bp, Artificial Sequence
  Synthetic Polynucleotide
ttcgagcttt

SEQ ID NO: 4388 - DNA, 10 bp, Artificial Sequence
  Synthetic Polynucleotide
tggaggcggg

SEQ ID NO: 4389 - DNA, 10 bp, Artificial Sequence
  Synthetic Polynucleotide
ttcaccgacg

SEQ ID NO: 4390 - DNA, 10 bp, Artificial Sequence
  Synthetic Polynucleotide
cgtctgtgtt

SEQ ID NO: 4391 - DNA, 10 bp, Artificial Sequence
  Synthetic Polynucleotide
ccctctggcc

SEQ ID NO: 4392 - DNA, 10 bp, Artificial Sequence
  Synthetic Polynucleotide
tcatgcaata

SEQ ID NO: 4393 - DNA, 10 bp, Artificial Sequence
  Synthetic Polynucleotide
tacatcctac

SEQ ID NO: 4394 - DNA, 10 bp, Artificial Sequence
  Synthetic Polynucleotide
aactcaccag

SEQ ID NO: 4395 - DNA, 10 bp, Artificial Sequence
  Synthetic Polynucleotide
acgattgctg

SEQ ID NO: 4396 - DNA, 10 bp, Artificial Sequence
  Synthetic Polynucleotide
gccatcctga

SEQ ID NO: 4397 - DNA, 10 bp, Artificial Sequence
  Synthetic Polynucleotide
ctgatgaaca

SEQ ID NO: 4398 - DNA, 10 bp, Artificial Sequence
  Synthetic Polynucleotide
taatgaatga

SEQ ID NO: 4399 - DNA, 10 bp, Artificial Sequence
  Synthetic Polynucleotide
cggttcagaa

SEQ ID NO: 4400 - DNA, 10 bp, Artificial Sequence
  Synthetic Polynucleotide
acgactatct

SEQ ID NO: 4401 - DNA, 10 bp, Artificial Sequence
  Synthetic Polynucleotide
acccagtgtt

SEQ ID NO: 4402 - DNA, 10 bp, Artificial Sequence
  Synthetic Polynucleotide
atctggtttt

SEQ ID NO: 4403 - DNA, 10 bp, Artificial Sequence
  Synthetic Polynucleotide
tgatgatgtt

SEQ ID NO: 4404 - DNA, 10 bp, Artificial Sequence
  Synthetic Polynucleotide
agctgcatcg

SEQ ID NO: 4405 - DNA, 10 bp, Artificial Sequence
  Synthetic Polynucleotide
agcagctatc

SEQ ID NO: 4406 - DNA, 10 bp, Artificial Sequence
  Synthetic Polynucleotide
tcgtaatcca

SEQ ID NO: 4407 - DNA, 10 bp, Artificial Sequence
  Synthetic Polynucleotide
atcttcgctt

SEQ ID NO: 4408 - DNA, 10 bp, Artificial Sequence
  Synthetic Polynucleotide
tcgtaattac

SEQ ID NO: 4409 - DNA, 10 bp, Artificial Sequence
  Synthetic Polynucleotide
tcattaccac

SEQ ID NO: 4410 - DNA, 10 bp, Artificial Sequence
  Synthetic Polynucleotide
aagcaattca

SEQ ID NO: 4411 - DNA, 10 bp, Artificial Sequence
  Synthetic Polynucleotide
acttcttctg

SEQ ID NO: 4412 - DNA, 10 bp, Artificial Sequence
  Synthetic Polynucleotide
gcgaaaaggg

SEQ ID NO: 4413 - DNA, 10 bp, Artificial Sequence
  Synthetic Polynucleotide
gacgacaaca

SEQ ID NO: 4414 - DNA, 10 bp, Artificial Sequence
  Synthetic Polynucleotide
tttatgttgg

SEQ ID NO: 4415 - DNA, 10 bp, Artificial Sequence
  Synthetic Polynucleotide
ctccctccaa

SEQ ID NO: 4416 - DNA, 10 bp, Artificial Sequence
  Synthetic Polynucleotide
gttgttgggc

SEQ ID NO: 4417 - DNA, 10 bp, Artificial Sequence
  Synthetic Polynucleotide
ctatctgaag

SEQ ID NO: 4418 - DNA, 19 bp, Artificial Sequence
  Synthetic Polynucleotide
atatcaaatcctcctcgtt

SEQ ID NO: 4419 - DNA, 18 bp, Artificial Sequence
  Synthetic Polynucleotide
tttgatgcgtttcttacc

SEQ ID NO: 4420 - DNA, 17 bp, Artificial Sequence
  Synthetic Polynucleotide
ccactcgtaggtgtagg

SEQ ID NO: 4421 - DNA, 17 bp, Artificial Sequence
  Synthetic Polynucleotide
tcgatgatgccgcagtg

SEQ ID NO: 4422 - DNA, 17 bp, Artificial Sequence
  Synthetic Polynucleotide
tccttgtctatgggcac

SEQ ID NO: 4423 - DNA, 17 bp, Artificial Sequence
  Synthetic Polynucleotide
gccatgacggaccagtt

SEQ ID NO: 4424 - DNA, 17 bp, Artificial Sequence
  Synthetic Polynucleotide
cgcaatggggagctaat

SEQ ID NO: 4425 - DNA, 19 bp, Artificial Sequence
  Synthetic Polynucleotide
cccctttgttgcagatcac

SEQ ID NO: 4426 - DNA, 20 bp, Artificial Sequence
  Synthetic Polynucleotide
atttgaaatggaagaaccta

SEQ ID NO: 4427 - DNA, 20 bp, Artificial Sequence
  Synthetic Polynucleotide
atgtttgaaaatttagcacc

SEQ ID NO: 4428 - DNA, 18 bp, Artificial Sequence
  Synthetic Polynucleotide
atctccttggaactcatg

SEQ ID NO: 4429 - DNA, 20 bp, Artificial Sequence
  Synthetic Polynucleotide
gattgcttacctgactatga

SEQ ID NO: 4430 - DNA, 17 bp, Artificial Sequence
  Synthetic Polynucleotide
aattgggtcaagagcga

SEQ ID NO: 4431 - DNA, 17 bp, Artificial Sequence
  Synthetic Polynucleotide
acatgttcggtttgacc

SEQ ID NO: 4432 - DNA, 18 bp, Artificial Sequence
  Synthetic Polynucleotide
taggtgaaatagggatcg

SEQ ID NO: 4433 - DNA, 19 bp, Artificial Sequence
  Synthetic Polynucleotide
aacgtgaatccctttaacc

SEQ ID NO: 4434 - DNA, 19 bp, Artificial Sequence
  Synthetic Polynucleotide
tgcattgggaattgtagta

SEQ ID NO: 4435 - DNA, 17 bp, Artificial Sequence
  Synthetic Polynucleotide
cgtagatgggaccaaac

SEQ ID NO: 4436 - DNA, 18 bp, Artificial Sequence
  Synthetic Polynucleotide
tcacatcaacagccattc

SEQ ID NO: 4437 - DNA, 20 bp, Artificial Sequence
  Synthetic Polynucleotide
ctggggtgacacagtagaag

SEQ ID NO: 4438 - DNA, 18 bp, Artificial Sequence
  Synthetic Polynucleotide
aaccaatccagtaacacg

SEQ ID NO: 4439 - DNA, 19 bp, Artificial Sequence
  Synthetic Polynucleotide
gcgtattggaaacagtgac

SEQ ID NO: 4440 - DNA, 20 bp, Artificial Sequence
  Synthetic Polynucleotide
gtgaactttctttgctgctg

SEQ ID NO: 4441 - DNA, 20 bp, Artificial Sequence
  Synthetic Polynucleotide
attaaaccctttagcagttg

SEQ ID NO: 4442 - DNA, 18 bp, Artificial Sequence
  Synthetic Polynucleotide
ccctttgtaaagcctgag

SEQ ID NO: 4443 - DNA, 20 bp, Artificial Sequence
  Synthetic Polynucleotide
gtctgagagttttgtaccag

SEQ ID NO: 4444 - DNA, 18 bp, Artificial Sequence
  Synthetic Polynucleotide
acgggaagtttcagtgat

SEQ ID NO: 4445 - DNA, 20 bp, Artificial Sequence
  Synthetic Polynucleotide
ttaagtggaccttatccaac

SEQ ID NO: 4446 - DNA, 20 bp, Artificial Sequence
  Synthetic Polynucleotide
cgtatcaatcacattaggta

SEQ ID NO: 4447 - DNA, 17 bp, Artificial Sequence
  Synthetic Polynucleotide
gctgatcttggaagtgc

SEQ ID NO: 4448 - DNA, 17 bp, Artificial Sequence
  Synthetic Polynucleotide
gatgcaatgccaggagt

SEQ ID NO: 4449 - DNA, 17 bp, Artificial Sequence
  Synthetic Polynucleotide
actggggaggcactgct

SEQ ID NO: 4450 - DNA, 17 bp, Artificial Sequence
  Synthetic Polynucleotide
tttgtcatgggtgaaga

SEQ ID NO: 4451 - DNA, 20 bp, Artificial Sequence
  Synthetic Polynucleotide
gttttcattcatcatgtcta

SEQ ID NO: 4452 - DNA, 19 bp, Artificial Sequence
  Synthetic Polynucleotide
acttatagacgggagaaca

SEQ ID NO: 4453 - DNA, 17 bp, Artificial Sequence
  Synthetic Polynucleotide
tggtccacactgatccc

SEQ ID NO: 4454 - DNA, 17 bp, Artificial Sequence
  Synthetic Polynucleotide
tcaggtgaaggatggcc

SEQ ID NO: 4455 - DNA, 18 bp, Artificial Sequence
  Synthetic Polynucleotide
gtggagagtcagggaggc

SEQ ID NO: 4456 - DNA, 17 bp, Artificial Sequence
  Synthetic Polynucleotide
tcatgtttgatgcaaca

SEQ ID NO: 4457 - DNA, 20 bp, Artificial Sequence
  Synthetic Polynucleotide
cgtacctcaatgaaacgcat

SEQ ID NO: 4458 - DNA, 18 bp, Artificial Sequence
  Synthetic Polynucleotide
cacaaagaacaacagtca

SEQ ID NO: 4459 - DNA, 20 bp, Artificial Sequence
  Synthetic Polynucleotide
catttactgctttgttgatc

SEQ ID NO: 4460 - DNA, 18 bp, Artificial Sequence
  Synthetic Polynucleotide
tgaacaggaagtttggga

SEQ ID NO: 4461 - DNA, 17 bp, Artificial Sequence
  Synthetic Polynucleotide
gcctacatcacaaatgc

SEQ ID NO: 4462 - DNA, 19 bp, Artificial Sequence
  Synthetic Polynucleotide
tttatgctctgctgaactt

SEQ ID NO: 4463 - DNA, 18 bp, Artificial Sequence
  Synthetic Polynucleotide
cagaacacatcatgggag

SEQ ID NO: 4464 - DNA, 17 bp, Artificial Sequence
  Synthetic Polynucleotide
tgtcacatgcacacagg

SEQ ID NO: 4465 - DNA, 18 bp, Artificial Sequence
  Synthetic Polynucleotide
tccatttacaggacgact

SEQ ID NO: 4466 - DNA, 19 bp, Artificial Sequence
  Synthetic Polynucleotide
gctgaaactattgacacta

SEQ ID NO: 4467 - DNA, 17 bp, Artificial Sequence
  Synthetic Polynucleotide
tctgagaatcgaacaca

SEQ ID NO: 4468 - DNA, 19 bp, Artificial Sequence
  Synthetic Polynucleotide
gtcaagggtctgatgatat

SEQ ID NO: 4469 - DNA, 18 bp, Artificial Sequence
  Synthetic Polynucleotide
gccacaatcaagggaatg

SEQ ID NO: 4470 - DNA, 18 bp, Artificial Sequence
  Synthetic Polynucleotide
aactgagaaagaaggtgc

SEQ ID NO: 4471 - DNA, 20 bp, Artificial Sequence
  Synthetic Polynucleotide
ggcttggtctgatgataact

SEQ ID NO: 4472 - DNA, 19 bp, Artificial Sequence
  Synthetic Polynucleotide
aggcaagatctgaagattg

SEQ ID NO: 4473 - DNA, 20 bp, Artificial Sequence
  Synthetic Polynucleotide
atcatatcaattctgaaggg

SEQ ID NO: 4474 - DNA, 19 bp, Artificial Sequence
  Synthetic Polynucleotide
ttgaagaactcacttggaa

SEQ ID NO: 4475 - DNA, 20 bp, Artificial Sequence
  Synthetic Polynucleotide
gaataagatgtctagtggta

SEQ ID NO: 4476 - DNA, 18 bp, Artificial Sequence
  Synthetic Polynucleotide
gagggatgtctgcaagaa

SEQ ID NO: 4477 - DNA, 20 bp, Artificial Sequence
  Synthetic Polynucleotide
cccattcggtaagagaacca

SEQ ID NO: 4478 - DNA, 18 bp, Artificial Sequence
  Synthetic Polynucleotide
taggcatttaggattgcg

SEQ ID NO: 4479 - DNA, 18 bp, Artificial Sequence
  Synthetic Polynucleotide
tggtcattatacagtccc

SEQ ID NO: 4480 - DNA, 19 bp, Artificial Sequence
  Synthetic Polynucleotide
gccatttaccaacctgaaa

SEQ ID NO: 4481 - DNA, 20 bp, Artificial Sequence
  Synthetic Polynucleotide
agttactcaccaatgtctac

SEQ ID NO: 4482 - DNA, 19 bp, Artificial Sequence
  Synthetic Polynucleotide
atgttcccaaacccaagac

SEQ ID NO: 4483 - DNA, 20 bp, Artificial Sequence
  Synthetic Polynucleotide
ggatcattcaactcctaatg

SEQ ID NO: 4484 - DNA, 20 bp, Artificial Sequence
  Synthetic Polynucleotide
tcatcacccaagaacaatca

SEQ ID NO: 4485 - DNA, 17 bp, Artificial Sequence
  Synthetic Polynucleotide
tcctggtctctgcttag

SEQ ID NO: 4486 - DNA, 19 bp, Artificial Sequence
  Synthetic Polynucleotide
agcaataaaagtgtggttg

SEQ ID NO: 4487 - DNA, 19 bp, Artificial Sequence
  Synthetic Polynucleotide
gaattgctttccctttcac

SEQ ID NO: 4488 - DNA, 20 bp, Artificial Sequence
  Synthetic Polynucleotide
aatctgtgatatgaagatgg

SEQ ID NO: 4489 - DNA, 19 bp, Artificial Sequence
  Synthetic Polynucleotide
ggtttaacagcccaaaaga

SEQ ID NO: 4490 - DNA, 18 bp, Artificial Sequence
  Synthetic Polynucleotide
gactgcatcatgtttgat

SEQ ID NO: 4491 - DNA, 17 bp, Artificial Sequence
  Synthetic Polynucleotide
cactgccaattctcaag

SEQ ID NO: 4492 - DNA, 20 bp, Artificial Sequence
  Synthetic Polynucleotide
tccactcatttctaaaatca

SEQ ID NO: 4493 - DNA, 17 bp, Artificial Sequence
  Synthetic Polynucleotide
ggaaggtcatgctcttt

SEQ ID NO: 4494 - DNA, 20 bp, Artificial Sequence
  Synthetic Polynucleotide
gatcatattgtctgcttcct

SEQ ID NO: 4495 - DNA, 17 bp, Artificial Sequence
  Synthetic Polynucleotide
tcctgctctctaatcta

SEQ ID NO: 4496 - DNA, 20 bp, Artificial Sequence
  Synthetic Polynucleotide
tggtcaattatagaggtgtt

SEQ ID NO: 4497 - DNA, 17 bp, Artificial Sequence
  Synthetic Polynucleotide
ttcttccaagaggtgcc

SEQ ID NO: 4498 - DNA, 17 bp, Artificial Sequence
  Synthetic Polynucleotide
ccctacgagaacatcct

SEQ ID NO: 4499 - DNA, 18 bp, Artificial Sequence
  Synthetic Polynucleotide
gaaatgtatgtactggcc

SEQ ID NO: 4500 - DNA, 20 bp, Artificial Sequence
  Synthetic Polynucleotide
tatatccaacgattccctat

SEQ ID NO: 4501 - DNA, 19 bp, Artificial Sequence
  Synthetic Polynucleotide
gatctactttcaaatcccc

SEQ ID NO: 4502 - DNA, 19 bp, Artificial Sequence
  Synthetic Polynucleotide
tgctcaaagtgttattctg

SEQ ID NO: 4503 - DNA, 20 bp, Artificial Sequence
  Synthetic Polynucleotide
atggaatgtccttgtacaga

SEQ ID NO: 4504 - DNA, 17 bp, Artificial Sequence
  Synthetic Polynucleotide
ttgacaacaaaatcggg

SEQ ID NO: 4505 - DNA, 19 bp, Artificial Sequence
  Synthetic Polynucleotide
atacccaattccctaactc

SEQ ID NO: 4506 - DNA, 20 bp, Artificial Sequence
  Synthetic Polynucleotide
ttgaacaatagtctccaaag

SEQ ID NO: 4507 - DNA, 20 bp, Artificial Sequence
  Synthetic Polynucleotide
tgtttcccaaataatgaaga

SEQ ID NO: 4508 - DNA, 18 bp, Artificial Sequence
  Synthetic Polynucleotide
atcctgggtcaaatggtc

SEQ ID NO: 4509 - DNA, 18 bp, Artificial Sequence
  Synthetic Polynucleotide
agcccgtccaacatcatt

SEQ ID NO: 4510 - DNA, 19 bp, Artificial Sequence
  Synthetic Polynucleotide
aacagatatccaccaaagt

SEQ ID NO: 4511 - DNA, 19 bp, Artificial Sequence
  Synthetic Polynucleotide
ttgaacactccttattgta

SEQ ID NO: 4512 - DNA, 19 bp, Artificial Sequence
  Synthetic Polynucleotide
atggaaaagagaagagcat

SEQ ID NO: 4513 - DNA, 17 bp, Artificial Sequence
  Synthetic Polynucleotide
tgacttctggtccaact

SEQ ID NO: 4514 - DNA, 19 bp, Artificial Sequence
  Synthetic Polynucleotide
ctggcattgcgtcctctat

SEQ ID NO: 4515 - DNA, 18 bp, Artificial Sequence
  Synthetic Polynucleotide
ctgtgaaggctggtgctt

SEQ ID NO: 4516 - DNA, 19 bp, Artificial Sequence
  Synthetic Polynucleotide
taaagtgtgtcttgaaggt

SEQ ID NO: 4517 - DNA, 18 bp, Artificial Sequence
  Synthetic Polynucleotide
tgtttgtactcgtcccaa

SEQ ID NO: 4518 - DNA, 17 bp, Artificial Sequence
  Synthetic Polynucleotide
tgagtctgtgtggctta

SEQ ID NO: 4519 - DNA, 17 bp, Artificial Sequence
  Synthetic Polynucleotide
atgtggcagatcatgtt

SEQ ID NO: 4520 - DNA, 19 bp, Artificial Sequence
  Synthetic Polynucleotide
gtccgaatttcaatctccc

SEQ ID NO: 4521 - DNA, 17 bp, Artificial Sequence
  Synthetic Polynucleotide
gactccgtgtccgttgg

SEQ ID NO: 4522 - DNA, 17 bp, Artificial Sequence
  Synthetic Polynucleotide
aactcattgtgtgcctg

SEQ ID NO: 4523 - DNA, 20 bp, Artificial Sequence
  Synthetic Polynucleotide
acatccctgtctgaagctca

SEQ ID NO: 4524 - DNA, 20 bp, Artificial Sequence
  Synthetic Polynucleotide
caatctcaaagctgaatcca

SEQ ID NO: 4525 - DNA, 18 bp, Artificial Sequence
  Synthetic Polynucleotide
caatcctgtgtgagaaag

SEQ ID NO: 4526 - DNA, 17 bp, Artificial Sequence
  Synthetic Polynucleotide
ctcatcccaaaccatga

SEQ ID NO: 4527 - DNA, 17 bp, Artificial Sequence
  Synthetic Polynucleotide
ttttcgtaggggttcct

SEQ ID NO: 4528 - DNA, 20 bp, Artificial Sequence
  Synthetic Polynucleotide
ccctaattgaataggtgact

SEQ ID NO: 4529 - DNA, 17 bp, Artificial Sequence
  Synthetic Polynucleotide
ggccagccagtcaatca

SEQ ID NO: 4530 - DNA, 19 bp, Artificial Sequence
  Synthetic Polynucleotide
cgagttgtgcctgtgacat

SEQ ID NO: 4531 - DNA, 17 bp, Artificial Sequence
  Synthetic Polynucleotide
caatgtcatgtggaagc

SEQ ID NO: 4532 - DNA, 17 bp, Artificial Sequence
  Synthetic Polynucleotide
gcaaagggatactacca

SEQ ID NO: 4533 - DNA, 19 bp, Artificial Sequence
  Synthetic Polynucleotide
ttcttgccactcgctctca

SEQ ID NO: 4534 - DNA, 18 bp, Artificial Sequence
  Synthetic Polynucleotide
caccgttcctatccaagg

SEQ ID NO: 4535 - DNA, 18 bp, Artificial Sequence
  Synthetic Polynucleotide
cctttaaccatgtctggg

SEQ ID NO: 4536 - DNA, 18 bp, Artificial Sequence
  Synthetic Polynucleotide
aacttttgacccaaaccg

SEQ ID NO: 4537 - DNA, 20 bp, Artificial Sequence
  Synthetic Polynucleotide
taaatgcttgaccatcgttg

SEQ ID NO: 4538 - DNA, 17 bp, Artificial Sequence
  Synthetic Polynucleotide
gtgccaaaacataccca

SEQ ID NO: 4539 - DNA, 19 bp, Artificial Sequence
  Synthetic Polynucleotide
ctgaatgcggataatgcag

SEQ ID NO: 4540 - DNA, 17 bp, Artificial Sequence
  Synthetic Polynucleotide
gaagacgaacatcacga

SEQ ID NO: 4541 - DNA, 18 bp, Artificial Sequence
  Synthetic Polynucleotide
ccagtcgctcgatacgtt

SEQ ID NO: 4542 - DNA, 18 bp, Artificial Sequence
  Synthetic Polynucleotide
ccgccgctctcatacact

SEQ ID NO: 4543 - DNA, 18 bp, Artificial Sequence
  Synthetic Polynucleotide
gacaagcatctcgtttca

SEQ ID NO: 4544 - DNA, 19 bp, Artificial Sequence
  Synthetic Polynucleotide
aggaggaaagattcttctc

SEQ ID NO: 4545 - DNA, 20 bp, Artificial Sequence
  Synthetic Polynucleotide
ggttccaaaattcttaccag

SEQ ID NO: 4546 - DNA, 18 bp, Artificial Sequence
  Synthetic Polynucleotide
gttttggtcctgtgacac

SEQ ID NO: 4547 - DNA, 17 bp, Artificial Sequence
  Synthetic Polynucleotide
cacagaagagcaactcc

SEQ ID NO: 4548 - DNA, 20 bp, Artificial Sequence
  Synthetic Polynucleotide
taccatgtattcctgcatct

SEQ ID NO: 4549 - DNA, 20 bp, Artificial Sequence
  Synthetic Polynucleotide
acttccaaggcgtggttgaa

SEQ ID NO: 4550 - DNA, 17 bp, Artificial Sequence
  Synthetic Polynucleotide
cctgtaccctcgatcct

SEQ ID NO: 4551 - DNA, 17 bp, Artificial Sequence
  Synthetic Polynucleotide
aatagggtgacggggtg

SEQ ID NO: 4552 - DNA, 18 bp, Artificial Sequence
  Synthetic Polynucleotide
ttggtagatcctcgaatc

SEQ ID NO: 4553 - DNA, 20 bp, Artificial Sequence
  Synthetic Polynucleotide
aggtgaggtttgtaagatct

SEQ ID NO: 4554 - DNA, 18 bp, Artificial Sequence
  Synthetic Polynucleotide
ctctgggatgtctgcacc

SEQ ID NO: 4555 - DNA, 20 bp, Artificial Sequence
  Synthetic Polynucleotide
gcagttagcaaaggaggtcg

SEQ ID NO: 4556 - DNA, 20 bp, Artificial Sequence
  Synthetic Polynucleotide
agccatagttattttggtcc

SEQ ID NO: 4557 - DNA, 19 bp, Artificial Sequence
  Synthetic Polynucleotide
aaattgaagaaaagccaga

SEQ ID NO: 4558 - DNA, 17 bp, Artificial Sequence
  Synthetic Polynucleotide
atgcacaagtttgacga

SEQ ID NO: 4559 - DNA, 20 bp, Artificial Sequence
  Synthetic Polynucleotide
tgtacttttgaaacatttgc

SEQ ID NO: 4560 - DNA, 17 bp, Artificial Sequence
  Synthetic Polynucleotide
atgggcttgtagaagtt

SEQ ID NO: 4561 - DNA, 17 bp, Artificial Sequence
  Synthetic Polynucleotide
aaagagtttctcaggga

SEQ ID NO: 4562 - DNA, 18 bp, Artificial Sequence
  Synthetic Polynucleotide
tggcgagcggtttgaaaa

SEQ ID NO: 4563 - DNA, 20 bp, Artificial Sequence
  Synthetic Polynucleotide
tgcgatttgtattcgtatcg

SEQ ID NO: 4564 - DNA, 17 bp, Artificial Sequence
  Synthetic Polynucleotide
tgcgttttgcacaattg

SEQ ID NO: 4565 - DNA, 19 bp, Artificial Sequence
  Synthetic Polynucleotide
gtatgtacggatcttcggc

SEQ ID NO: 4566 - DNA, 17 bp, Artificial Sequence
  Synthetic Polynucleotide
gtggaaatgacaccaca

SEQ ID NO: 4567 - DNA, 17 bp, Artificial Sequence
  Synthetic Polynucleotide
cacggtcttcgtatgga

SEQ ID NO: 4568 - DNA, 17 bp, Artificial Sequence
  Synthetic Polynucleotide
cccacttggctgactcg

SEQ ID NO: 4569 - DNA, 20 bp, Artificial Sequence
  Synthetic Polynucleotide
ggtcatgtataagacgtatg

SEQ ID NO: 4570 - DNA, 17 bp, Artificial Sequence
  Synthetic Polynucleotide
cccacatgttgctattg

SEQ ID NO: 4571 - DNA, 17 bp, Artificial Sequence
  Synthetic Polynucleotide
agttcacacggttcata

SEQ ID NO: 4572 - DNA, 18 bp, Artificial Sequence
  Synthetic Polynucleotide
acttatcaatctgtccgg

SEQ ID NO: 4573 - DNA, 19 bp, Artificial Sequence
  Synthetic Polynucleotide
agaagttctcccagatcac

SEQ ID NO: 4574 - DNA, 17 bp, Artificial Sequence
  Synthetic Polynucleotide
tggagcggtaaagagtt

SEQ ID NO: 4575 - DNA, 19 bp, Artificial Sequence
  Synthetic Polynucleotide
cttttggaaggtgcttcag

SEQ ID NO: 4576 - DNA, 17 bp, Artificial Sequence
  Synthetic Polynucleotide
atcaattttggcacggg

SEQ ID NO: 4577 - DNA, 19 bp, Artificial Sequence
  Synthetic Polynucleotide
ccaatttgatgtcgttgtg

SEQ ID NO: 4578 - DNA, 18 bp, Artificial Sequence
  Synthetic Polynucleotide
atggcgatttgtttgatt

SEQ ID NO: 4579 - DNA, 18 bp, Artificial Sequence
  Synthetic Polynucleotide
atgtattgtcgtatcggg

SEQ ID NO: 4580 - DNA, 19 bp, Artificial Sequence
  Synthetic Polynucleotide
cgattcttttcgttgagca

SEQ ID NO: 4581 - DNA, 19 bp, Artificial Sequence
  Synthetic Polynucleotide
tatgggtagtttgcgtaaa

SEQ ID NO: 4582 - DNA, 19 bp, Artificial Sequence
  Synthetic Polynucleotide
agtacattgagtttgttgc

SEQ ID NO: 4583 - DNA, 20 bp, Artificial Sequence
  Synthetic Polynucleotide
aaattttaattcccaccacc

SEQ ID NO: 4584 - DNA, 17 bp, Artificial Sequence
  Synthetic Polynucleotide
ttggaggggcttttaat

SEQ ID NO: 4585 - DNA, 17 bp, Artificial Sequence
  Synthetic Polynucleotide
cagatggtcgatgttct

SEQ ID NO: 4586 - DNA, 19 bp, Artificial Sequence
  Synthetic Polynucleotide
cgtagtcttttgatctccc

SEQ ID NO: 4587 - DNA, 17 bp, Artificial Sequence
  Synthetic Polynucleotide
gcagtttaccagaggcg

SEQ ID NO: 4588 - DNA, 19 bp, Artificial Sequence
  Synthetic Polynucleotide
gactttggtcgatgaataa

SEQ ID NO: 4589 - DNA, 17 bp, Artificial Sequence
  Synthetic Polynucleotide
aactttgaagcccgaca

SEQ ID NO: 4590 - DNA, 20 bp, Artificial Sequence
  Synthetic Polynucleotide
cagcaaaattcgtccgtatt

SEQ ID NO: 4591 - DNA, 17 bp, Artificial Sequence
  Synthetic Polynucleotide
agcgatagtacacgata

SEQ ID NO: 4592 - DNA, 18 bp, Artificial Sequence
  Synthetic Polynucleotide
tcatacctcatattgggg

SEQ ID NO: 4593 - DNA, 20 bp, Artificial Sequence
  Synthetic Polynucleotide
actacaatgtgggcatctta

SEQ ID NO: 4594 - DNA, 18 bp, Artificial Sequence
  Synthetic Polynucleotide
aagaggcactaaaagtga

SEQ ID NO: 4595 - DNA, 20 bp, Artificial Sequence
  Synthetic Polynucleotide
gttttgcctatgtatggtag

SEQ ID NO: 4596 - DNA, 18 bp, Artificial Sequence
  Synthetic Polynucleotide
gacataccacgactgttt

SEQ ID NO: 4597 - DNA, 18 bp, Artificial Sequence
  Synthetic Polynucleotide
accacgatgtttccgttc

SEQ ID NO: 4598 - DNA, 17 bp, Artificial Sequence
  Synthetic Polynucleotide
atctcacggaaatacga

SEQ ID NO: 4599 - DNA, 17 bp, Artificial Sequence
  Synthetic Polynucleotide
accccatccgcagttct

SEQ ID NO: 4600 - DNA, 18 bp, Artificial Sequence
  Synthetic Polynucleotide
aaacatgctgaggaacct

SEQ ID NO: 4601 - DNA, 18 bp, Artificial Sequence
  Synthetic Polynucleotide
tcctgctccatccaatag

SEQ ID NO: 4602 - DNA, 17 bp, Artificial Sequence
  Synthetic Polynucleotide
tggccgactacaatagg

SEQ ID NO: 4603 - DNA, 20 bp, Artificial Sequence
  Synthetic Polynucleotide
ctgaggttgtttcttgctgc

SEQ ID NO: 4604 - DNA, 18 bp, Artificial Sequence
  Synthetic Polynucleotide
caaaagagttcatggacc

SEQ ID NO: 4605 - DNA, 18 bp, Artificial Sequence
  Synthetic Polynucleotide
tctacccctttgggatac

SEQ ID NO: 4606 - DNA, 20 bp, Artificial Sequence
  Synthetic Polynucleotide
gttttcaatagtccacaggc

SEQ ID NO: 4607 - DNA, 20 bp, Artificial Sequence
  Synthetic Polynucleotide
cttcattcttgacaatgttc

SEQ ID NO: 4608 - DNA, 19 bp, Artificial Sequence
  Synthetic Polynucleotide
cagaggtgcaatcacacgg

SEQ ID NO: 4609 - DNA, 19 bp, Artificial Sequence
  Synthetic Polynucleotide
gatcttctcgcacgccttc

SEQ ID NO: 4610 - DNA, 19 bp, Artificial Sequence
  Synthetic Polynucleotide
cagcttacccacatcatat

SEQ ID NO: 4611 - DNA, 17 bp, Artificial Sequence
  Synthetic Polynucleotide
atccagggacgattacc

SEQ ID NO: 4612 - DNA, 18 bp, Artificial Sequence
  Synthetic Polynucleotide
aagaagatccccagacac

SEQ ID NO: 4613 - DNA, 20 bp, Artificial Sequence
  Synthetic Polynucleotide
gaaaccgaagaaaagaatgt

SEQ ID NO: 4614 - DNA, 17 bp, Artificial Sequence
  Synthetic Polynucleotide
taatcgtcgttgagacg

SEQ ID NO: 4615 - DNA, 17 bp, Artificial Sequence
  Synthetic Polynucleotide
gaaaccctccgaagagg

SEQ ID NO: 4616 - DNA, 17 bp, Artificial Sequence
  Synthetic Polynucleotide
cggctaaaatggtcagt

SEQ ID NO: 4617 - DNA, 20 bp, Artificial Sequence
  Synthetic Polynucleotide
acccgtaccctgaaactagc

SEQ ID NO: 4618 - DNA, 18 bp, Artificial Sequence
  Synthetic Polynucleotide
ccatgcacgaacccctaa

SEQ ID NO: 4619 - DNA, 17 bp, Artificial Sequence
  Synthetic Polynucleotide
gatagtcgtggttgaca

SEQ ID NO: 4620 - DNA, 17 bp, Artificial Sequence
  Synthetic Polynucleotide
gcgatgcctgcactctg

SEQ ID NO: 4621 - DNA, 18 bp, Artificial Sequence
  Synthetic Polynucleotide
tccatccagctaacggct

SEQ ID NO: 4622 - DNA, 19 bp, Artificial Sequence
  Synthetic Polynucleotide
tggagattatcagttcctt

SEQ ID NO: 4623 - DNA, 19 bp, Artificial Sequence
  Synthetic Polynucleotide
gagttactccttgctctct

SEQ ID NO: 4624 - DNA, 20 bp, Artificial Sequence
  Synthetic Polynucleotide
atctaaactctctccctgag

SEQ ID NO: 4625 - DNA, 17 bp, Artificial Sequence
  Synthetic Polynucleotide
aagtccatatgcccacc

SEQ ID NO: 4626 - DNA, 17 bp, Artificial Sequence
  Synthetic Polynucleotide
gcatcctaccttttggt

SEQ ID NO: 4627 - DNA, 18 bp, Artificial Sequence
  Synthetic Polynucleotide
agaggtttaagtcgaaga

SEQ ID NO: 4628 - DNA, 18 bp, Artificial Sequence
  Synthetic Polynucleotide
ggaggacccttcactagg

SEQ ID NO: 4629 - DNA, 20 bp, Artificial Sequence
  Synthetic Polynucleotide
attgcttttggtgatactaa

SEQ ID NO: 4630 - DNA, 18 bp, Artificial Sequence
  Synthetic Polynucleotide
tccacagttaagtaggta

SEQ ID NO: 4631 - DNA, 19 bp, Artificial Sequence
  Synthetic Polynucleotide
gcataaataccctttgaga

SEQ ID NO: 4632 - DNA, 17 bp, Artificial Sequence
  Synthetic Polynucleotide
agttgatgccacttacc

SEQ ID NO: 4633 - DNA, 20 bp, Artificial Sequence
  Synthetic Polynucleotide
ctttgtgccactattaccta

SEQ ID NO: 4634 - DNA, 19 bp, Artificial Sequence
  Synthetic Polynucleotide
tggtctccttagagatcac

SEQ ID NO: 4635 - DNA, 18 bp, Artificial Sequence
  Synthetic Polynucleotide
gttttactccttgaaccc

SEQ ID NO: 4636 - DNA, 17 bp, Artificial Sequence
  Synthetic Polynucleotide
tgcaattcctgttgaga

SEQ ID NO: 4637 - DNA, 20 bp, Artificial Sequence
  Synthetic Polynucleotide
tatggataaatacagacaca

SEQ ID NO: 4638 - DNA, 17 bp, Artificial Sequence
  Synthetic Polynucleotide
cttccgaagaggacaag

SEQ ID NO: 4639 - DNA, 20 bp, Artificial Sequence
  Synthetic Polynucleotide
tagagtcattggtctaagca

SEQ ID NO: 4640 - DNA, 19 bp, Artificial Sequence
  Synthetic Polynucleotide
gagttgttgttttcctagg

SEQ ID NO: 4641 - DNA, 20 bp, Artificial Sequence
  Synthetic Polynucleotide
ttgctttcaagtttgtcgtg

SEQ ID NO: 4642 - DNA, 19 bp, Artificial Sequence
  Synthetic Polynucleotide
agagacttccaatcgtttc

SEQ ID NO: 4643 - DNA, 20 bp, Artificial Sequence
  Synthetic Polynucleotide
tagcagttttgaatgagtac

SEQ ID NO: 4644 - DNA, 18 bp, Artificial Sequence
  Synthetic Polynucleotide
gtatctagcgaggagttt

SEQ ID NO: 4645 - DNA, 17 bp, Artificial Sequence
  Synthetic Polynucleotide
gagtcgtcgttgagacg

SEQ ID NO: 4646 - DNA, 18 bp, Artificial Sequence
  Synthetic Polynucleotide
tacccaaacttgattgtt

SEQ ID NO: 4647 - DNA, 18 bp, Artificial Sequence
  Synthetic Polynucleotide
cggtgatgaactttatgg

SEQ ID NO: 4648 - DNA, 20 bp, Artificial Sequence
  Synthetic Polynucleotide
acgtaggcattcatagcatt

SEQ ID NO: 4649 - DNA, 17 bp, Artificial Sequence
  Synthetic Polynucleotide
actttcgtgagctgatg

SEQ ID NO: 4650 - DNA, 18 bp, Artificial Sequence
  Synthetic Polynucleotide
ccttaggggcattcatgc

SEQ ID NO: 4651 - DNA, 19 bp, Artificial Sequence
  Synthetic Polynucleotide
ggttgaggtatagaatcct

SEQ ID NO: 4652 - DNA, 20 bp, Artificial Sequence
  Synthetic Polynucleotide
aactgaattggcatcaaact

SEQ ID NO: 4653 - DNA, 17 bp, Artificial Sequence
  Synthetic Polynucleotide
ctgcgatctttgtgacg

SEQ ID NO: 4654 - DNA, 19 bp, Artificial Sequence
  Synthetic Polynucleotide
ggtgagggcatgtacaaaa

SEQ ID NO: 4655 - DNA, 18 bp, Artificial Sequence
  Synthetic Polynucleotide
gagaaattcaaggaagcc

SEQ ID NO: 4656 - DNA, 20 bp, Artificial Sequence
  Synthetic Polynucleotide
taataggtacggctaattta

SEQ ID NO: 4657 - DNA, 18 bp, Artificial Sequence
  Synthetic Polynucleotide
tttccagaagttgaacgt

SEQ ID NO: 4658 - DNA, 19 bp, Artificial Sequence
  Synthetic Polynucleotide
tcatagaaataggcatcgt

SEQ ID NO: 4659 - DNA, 17 bp, Artificial Sequence
  Synthetic Polynucleotide
tggcggaatacaggcaa

SEQ ID NO: 4660 - DNA, 17 bp, Artificial Sequence
  Synthetic Polynucleotide
accaccatcgatttcaa

SEQ ID NO: 4661 - DNA, 19 bp, Artificial Sequence
  Synthetic Polynucleotide
atggtgatttccagaagtt

SEQ ID NO: 4662 - DNA, 17 bp, Artificial Sequence
  Synthetic Polynucleotide
ccggttgttttcgacaa

SEQ ID NO: 4663 - DNA, 17 bp, Artificial Sequence
  Synthetic Polynucleotide
aaactgtgcggaagcga

SEQ ID NO: 4664 - DNA, 19 bp, Artificial Sequence
  Synthetic Polynucleotide
gaacaggtaggagcggaca

SEQ ID NO: 4665 - DNA, 18 bp, Artificial Sequence
  Synthetic Polynucleotide
ggcattctccaaggtact

SEQ ID NO: 4666 - DNA, 19 bp, Artificial Sequence
  Synthetic Polynucleotide
tacacataactgagaacac

SEQ ID NO: 4667 - DNA, 19 bp, Artificial Sequence
  Synthetic Polynucleotide
aatcccgagttgttgaaac

SEQ ID NO: 4668 - DNA, 20 bp, Artificial Sequence
  Synthetic Polynucleotide
acgagttaaccaaaaggatt

SEQ ID NO: 4669 - DNA, 19 bp, Artificial Sequence
  Synthetic Polynucleotide
agacttactagaaccagta

SEQ ID NO: 4670 - DNA, 19 bp, Artificial Sequence
  Synthetic Polynucleotide
attgtgaggaaactttgtc

SEQ ID NO: 4671 - DNA, 19 bp, Artificial Sequence
  Synthetic Polynucleotide
gagggaaaagagagttgta

SEQ ID NO: 4672 - DNA, 19 bp, Artificial Sequence
  Synthetic Polynucleotide
tcacccgagtgtagtcatt

SEQ ID NO: 4673 - DNA, 18 bp, Artificial Sequence
  Synthetic Polynucleotide
accagagacacttgattt

SEQ ID NO: 4674 - DNA, 17 bp, Artificial Sequence
  Synthetic Polynucleotide
ccgggagtgggtgatat

SEQ ID NO: 4675 - DNA, 17 bp, Artificial Sequence
  Synthetic Polynucleotide
caagtccgaagacgata

SEQ ID NO: 4676 - DNA, 19 bp, Artificial Sequence
  Synthetic Polynucleotide
cggttcttccataatctgg

SEQ ID NO: 4677 - DNA, 17 bp, Artificial Sequence
  Synthetic Polynucleotide
cgcatacacaggcggag

SEQ ID NO: 4678 - DNA, 17 bp, Artificial Sequence
  Synthetic Polynucleotide
cactcaggctcacaaag

SEQ ID NO: 4679 - DNA, 19 bp, Artificial Sequence
  Synthetic Polynucleotide
cggggatgctttcacttac

SEQ ID NO: 4680 - DNA, 20 bp, Artificial Sequence
  Synthetic Polynucleotide
gaaatcacatcagacatctt

SEQ ID NO: 4681 - DNA, 20 bp, Artificial Sequence
  Synthetic Polynucleotide
tattttatgggtgtttgagg

SEQ ID NO: 4682 - DNA, 20 bp, Artificial Sequence
  Synthetic Polynucleotide
tgtttggaacagtccattca

SEQ ID NO: 4683 - DNA, 18 bp, Artificial Sequence
  Synthetic Polynucleotide
gaatgtcacgaaaaggta

SEQ ID NO: 4684 - DNA, 20 bp, Artificial Sequence
  Synthetic Polynucleotide
atgaagtcgatcctatcagg

SEQ ID NO: 4685 - DNA, 18 bp, Artificial Sequence
  Synthetic Polynucleotide
aagttcttcagggagcat

SEQ ID NO: 4686 - DNA, 19 bp, Artificial Sequence
  Synthetic Polynucleotide
cctatacttaactcaggct

SEQ ID NO: 4687 - DNA, 19 bp, Artificial Sequence
  Synthetic Polynucleotide
tcacgggtctccatcagtt

SEQ ID NO: 4688 - DNA, 19 bp, Artificial Sequence
  Synthetic Polynucleotide
ggcaatttgggtccagact

SEQ ID NO: 4689 - DNA, 17 bp, Artificial Sequence
  Synthetic Polynucleotide
aagttgtggggaaaact

SEQ ID NO: 4690 - DNA, 19 bp, Artificial Sequence
  Synthetic Polynucleotide
atctctcagaaggggtgaa

SEQ ID NO: 4691 - DNA, 17 bp, Artificial Sequence
  Synthetic Polynucleotide
gtttgcagggtttgaag

SEQ ID NO: 4692 - DNA, 19 bp, Artificial Sequence
  Synthetic Polynucleotide
gtctaagcgggaggtaact

SEQ ID NO: 4693 - DNA, 18 bp, Artificial Sequence
  Synthetic Polynucleotide
gtacctccagtaattcca

SEQ ID NO: 4694 - DNA, 17 bp, Artificial Sequence
  Synthetic Polynucleotide
gtctcggggtccatctc

SEQ ID NO: 4695 - DNA, 17 bp, Artificial Sequence
  Synthetic Polynucleotide
tagtggctttgtctagg

SEQ ID NO: 4696 - DNA, 19 bp, Artificial Sequence
  Synthetic Polynucleotide
tagcttcaacagctaagtg

SEQ ID NO: 4697 - DNA, 17 bp, Artificial Sequence
  Synthetic Polynucleotide
cctagtagcggggtatt

SEQ ID NO: 4698 - DNA, 19 bp, Artificial Sequence
  Synthetic Polynucleotide
cactaatctcagtggtgga

SEQ ID NO: 4699 - DNA, 17 bp, Artificial Sequence
  Synthetic Polynucleotide
ggggcacagtagttatg

SEQ ID NO: 4700 - DNA, 18 bp, Artificial Sequence
  Synthetic Polynucleotide
gtgatcaacgaaaacgcg

SEQ ID NO: 4701 - DNA, 20 bp, Artificial Sequence
  Synthetic Polynucleotide
ctttccagttttgaattcct

SEQ ID NO: 4702 - DNA, 18 bp, Artificial Sequence
  Synthetic Polynucleotide
ttctatattctcgggagc

SEQ ID NO: 4703 - DNA, 18 bp, Artificial Sequence
  Synthetic Polynucleotide
agtgtttcagtatggccg

SEQ ID NO: 4704 - DNA, 18 bp, Artificial Sequence
  Synthetic Polynucleotide
tccttgaaaagcaatcaa

SEQ ID NO: 4705 - DNA, 18 bp, Artificial Sequence
  Synthetic Polynucleotide
tagtagtagactccttga

SEQ ID NO: 4706 - DNA, 18 bp, Artificial Sequence
  Synthetic Polynucleotide
ggttaagctcactaagga

SEQ ID NO: 4707 - DNA, 19 bp, Artificial Sequence
  Synthetic Polynucleotide
actgaagcaataagaggta

SEQ ID NO: 4708 - DNA, 20 bp, Artificial Sequence
  Synthetic Polynucleotide
tcatcatatttcttgagtga

SEQ ID NO: 4709 - DNA, 19 bp, Artificial Sequence
  Synthetic Polynucleotide
acttatgaacaggtttgca

SEQ ID NO: 4710 - DNA, 19 bp, Artificial Sequence
  Synthetic Polynucleotide
acaacaacaaaggcactga

SEQ ID NO: 4711 - DNA, 18 bp, Artificial Sequence
  Synthetic Polynucleotide
cagttttgatgtcttgct

SEQ ID NO: 4712 - DNA, 20 bp, Artificial Sequence
  Synthetic Polynucleotide
tagtagtatgctccctaaaa

SEQ ID NO: 4713 - DNA, 20 bp, Artificial Sequence
  Synthetic Polynucleotide
gtagtagactccctaaagag

SEQ ID NO: 4714 - DNA, 19 bp, Artificial Sequence
  Synthetic Polynucleotide
actgggcatccaaatggct

SEQ ID NO: 4715 - DNA, 18 bp, Artificial Sequence
  Synthetic Polynucleotide
gtcacaaacaaccaggat

SEQ ID NO: 4716 - DNA, 18 bp, Artificial Sequence
  Synthetic Polynucleotide
caaagctccctagagata

SEQ ID NO: 4717 - DNA, 19 bp, Artificial Sequence
  Synthetic Polynucleotide
aactctcggacccactgtt

SEQ ID NO: 4718 - DNA, 19 bp, Artificial Sequence
  Synthetic Polynucleotide
ccttcttcattttcttggt

SEQ ID NO: 4719 - DNA, 18 bp, Artificial Sequence
  Synthetic Polynucleotide
aaaggaaatggacttgtg

SEQ ID NO: 4720 - DNA, 17 bp, Artificial Sequence
  Synthetic Polynucleotide
gcagacccatatcacaa

SEQ ID NO: 4721 - DNA, 20 bp, Artificial Sequence
  Synthetic Polynucleotide
tcttcttctgatgaaaagct

SEQ ID NO: 4722 - DNA, 17 bp, Artificial Sequence
  Synthetic Polynucleotide
cctaccacccacccatt

SEQ ID NO: 4723 - DNA, 20 bp, Artificial Sequence
  Synthetic Polynucleotide
aacaacgatcttaccatcca

SEQ ID NO: 4724 - DNA, 20 bp, Artificial Sequence
  Synthetic Polynucleotide
cacattgtaaatgtcaaaga

SEQ ID NO: 4725 - DNA, 17 bp, Artificial Sequence
  Synthetic Polynucleotide
aactgtcaccccaatgg

SEQ ID NO: 4726 - DNA, 17 bp, Artificial Sequence
  Synthetic Polynucleotide
ctgacacacttgtttcc

SEQ ID NO: 4727 - DNA, 18 bp, Artificial Sequence
  Synthetic Polynucleotide
agtagtagactccgcaag

SEQ ID NO: 4728 - DNA, 17 bp, Artificial Sequence
  Synthetic Polynucleotide
gaccccaccaaaagtaa

SEQ ID NO: 4729 - DNA, 19 bp, Artificial Sequence
  Synthetic Polynucleotide
ttttcaacgatgtaccaca

SEQ ID NO: 4730 - DNA, 17 bp, Artificial Sequence
  Synthetic Polynucleotide
actccatgtcagcaact

SEQ ID NO: 4731 - DNA, 18 bp, Artificial Sequence
  Synthetic Polynucleotide
cagatgtactctcctgtc

SEQ ID NO: 4732 - DNA, 19 bp, Artificial Sequence
  Synthetic Polynucleotide
ctggtataagaacccatcc

SEQ ID NO: 4733 - DNA, 17 bp, Artificial Sequence
  Synthetic Polynucleotide
aagcagtcaatcagcaa

SEQ ID NO: 4734 - DNA, 18 bp, Artificial Sequence
  Synthetic Polynucleotide
tccgtagtcaggcagtgg

SEQ ID NO: 4735 - DNA, 20 bp, Artificial Sequence
  Synthetic Polynucleotide
aatacatttgatccagaagc

SEQ ID NO: 4736 - DNA, 17 bp, Artificial Sequence
  Synthetic Polynucleotide
aaagatatcgttgccgc

SEQ ID NO: 4737 - DNA, 17 bp, Artificial Sequence
  Synthetic Polynucleotide
ccgcttacgcccacagt

SEQ ID NO: 4738 - DNA, 18 bp, Artificial Sequence
  Synthetic Polynucleotide
attcccacccataaatgt

SEQ ID NO: 4739 - DNA, 18 bp, Artificial Sequence
  Synthetic Polynucleotide
tcaatgggaatacaactg

SEQ ID NO: 4740 - DNA, 18 bp, Artificial Sequence
  Synthetic Polynucleotide
ggatagctcagtttcaca

SEQ ID NO: 4741 - DNA, 20 bp, Artificial Sequence
  Synthetic Polynucleotide
aaatgtccttgatgtgaatg

SEQ ID NO: 4742 - DNA, 18 bp, Artificial Sequence
  Synthetic Polynucleotide
gttgaggtagtgttgttg

SEQ ID NO: 4743 - DNA, 19 bp, Artificial Sequence
  Synthetic Polynucleotide
taggatgtcaccttaagtg

SEQ ID NO: 4744 - DNA, 17 bp, Artificial Sequence
  Synthetic Polynucleotide
tctgtccccaaccaccc

SEQ ID NO: 4745 - DNA, 18 bp, Artificial Sequence
  Synthetic Polynucleotide
gatggtcttaccctccac

SEQ ID NO: 4746 - DNA, 19 bp, Artificial Sequence
  Synthetic Polynucleotide
gacatatgctgattgaagc

SEQ ID NO: 4747 - DNA, 18 bp, Artificial Sequence
  Synthetic Polynucleotide
ctgtgaagtcaggatggt

SEQ ID NO: 4748 - DNA, 17 bp, Artificial Sequence
  Synthetic Polynucleotide
ctccagctaagtgctat

SEQ ID NO: 4749 - DNA, 19 bp, Artificial Sequence
  Synthetic Polynucleotide
atgcaatagatgctgaaat

SEQ ID NO: 4750 - DNA, 17 bp, Artificial Sequence
  Synthetic Polynucleotide
ccccaaccagtctcata

SEQ ID NO: 4751 - DNA, 18 bp, Artificial Sequence
  Synthetic Polynucleotide
tggatggatgctacattt

SEQ ID NO: 4752 - DNA, 20 bp, Artificial Sequence
  Synthetic Polynucleotide
tagaatgatgatttctttcg

SEQ ID NO: 4753 - DNA, 18 bp, Artificial Sequence
  Synthetic Polynucleotide
ggatgcagaaaagcagta

SEQ ID NO: 4754 - DNA, 17 bp, Artificial Sequence
  Synthetic Polynucleotide
gctttgaccttcgccgc

SEQ ID NO: 4755 - DNA, 18 bp, Artificial Sequence
  Synthetic Polynucleotide
caatacatttgaccctga

SEQ ID NO: 4756 - DNA, 19 bp, Artificial Sequence
  Synthetic Polynucleotide
actgtaaatttgacccctg

SEQ ID NO: 4757 - DNA, 18 bp, Artificial Sequence
  Synthetic Polynucleotide
ttgctagagtcttcttcc

SEQ ID NO: 4758 - DNA, 20 bp, Artificial Sequence
  Synthetic Polynucleotide
aatttgaccccaccaaaagt

SEQ ID NO: 4759 - DNA, 20 bp, Artificial Sequence
  Synthetic Polynucleotide
ttttgaagatgtaccacaac

SEQ ID NO: 4760 - DNA, 19 bp, Artificial Sequence
  Synthetic Polynucleotide
tgagttcttgatatgcagt

SEQ ID NO: 4761 - DNA, 20 bp, Artificial Sequence
  Synthetic Polynucleotide
cctttcaatagattcaggtt

SEQ ID NO: 4762 - DNA, 19 bp, Artificial Sequence
  Synthetic Polynucleotide
tgctccttgaaaagcaatc

SEQ ID NO: 4763 - DNA, 18 bp, Artificial Sequence
  Synthetic Polynucleotide
actccttgagaagctact

SEQ ID NO: 4764 - DNA, 19 bp, Artificial Sequence
  Synthetic Polynucleotide
atatcgcactcatggcaat

SEQ ID NO: 4765 - DNA, 17 bp, Artificial Sequence
  Synthetic Polynucleotide
atggctagttgctgatt

SEQ ID NO: 4766 - DNA, 19 bp, Artificial Sequence
  Synthetic Polynucleotide
gttacactggtaaagttgg

SEQ ID NO: 4767 - DNA, 18 bp, Artificial Sequence
  Synthetic Polynucleotide
gcagcttcaatgaaatta

SEQ ID NO: 4768 - DNA, 19 bp, Artificial Sequence
  Synthetic Polynucleotide
taatgctgtcggtggacac

SEQ ID NO: 4769 - DNA, 18 bp, Artificial Sequence
  Synthetic Polynucleotide
ctgctgagacattcatgg

SEQ ID NO: 4770 - DNA, 19 bp, Artificial Sequence
  Synthetic Polynucleotide
taatggtcaatgtattccc

SEQ ID NO: 4771 - DNA, 20 bp, Artificial Sequence
  Synthetic Polynucleotide
accatagagggaactgaaac

SEQ ID NO: 4772 - DNA, 20 bp, Artificial Sequence
  Synthetic Polynucleotide
cattttgaattccgttttca

SEQ ID NO: 4773 - DNA, 19 bp, Artificial Sequence
  Synthetic Polynucleotide
atgaggaagaacaactcgt

SEQ ID NO: 4774 - DNA, 17 bp, Artificial Sequence
  Synthetic Polynucleotide
ggtagacttctggcccg

SEQ ID NO: 4775 - DNA, 19 bp, Artificial Sequence
  Synthetic Polynucleotide
gaagttacgcttaaccttg

SEQ ID NO: 4776 - DNA, 19 bp, Artificial Sequence
  Synthetic Polynucleotide
aaatgatgcaggcacacgg

SEQ ID NO: 4777 - DNA, 19 bp, Artificial Sequence
  Synthetic Polynucleotide
aatctacatgcacccctgt

SEQ ID NO: 4778 - DNA, 20 bp, Artificial Sequence
  Synthetic Polynucleotide
gtagtttggatcagaatcac

SEQ ID NO: 4779 - DNA, 19 bp, Artificial Sequence
  Synthetic Polynucleotide
agcaagataaaacccaacg

SEQ ID NO: 4780 - DNA, 18 bp, Artificial Sequence
  Synthetic Polynucleotide
tgagacaacagaaagagc

SEQ ID NO: 4781 - DNA, 20 bp, Artificial Sequence
  Synthetic Polynucleotide
gaggctaaatacttggagaa

SEQ ID NO: 4782 - DNA, 20 bp, Artificial Sequence
  Synthetic Polynucleotide
taggaaaagtttgcactgtg

SEQ ID NO: 4783 - DNA, 20 bp, Artificial Sequence
  Synthetic Polynucleotide
agagtttcactgtaatgctc

SEQ ID NO: 4784 - DNA, 20 bp, Artificial Sequence
  Synthetic Polynucleotide
acacacatagcttggattac

SEQ ID NO: 4785 - DNA, 20 bp, Artificial Sequence
  Synthetic Polynucleotide
tcaaaacataaagagctagg

SEQ ID NO: 4786 - DNA, 19 bp, Artificial Sequence
  Synthetic Polynucleotide
tgatgaacaatacaggcac

SEQ ID NO: 4787 - DNA, 20 bp, Artificial Sequence
  Synthetic Polynucleotide
tttctgctatcccaggttgg

SEQ ID NO: 4788 - DNA, 19 bp, Artificial Sequence
  Synthetic Polynucleotide
ctattgctcccctaatttc

SEQ ID NO: 4789 - DNA, 20 bp, Artificial Sequence
  Synthetic Polynucleotide
gtgtcgctagaattttcttc

SEQ ID NO: 4790 - DNA, 17 bp, Artificial Sequence
  Synthetic Polynucleotide
gctgtgtattggggaaa

SEQ ID NO: 4791 - DNA, 19 bp, Artificial Sequence
  Synthetic Polynucleotide
gggtatgtggcatttattg

SEQ ID NO: 4792 - DNA, 18 bp, Artificial Sequence
  Synthetic Polynucleotide
aaacaccatgtctaacgt

SEQ ID NO: 4793 - DNA, 18 bp, Artificial Sequence
  Synthetic Polynucleotide
acattcaacccataagca

SEQ ID NO: 4794 - DNA, 18 bp, Artificial Sequence
  Synthetic Polynucleotide
atcatgttgtgcaatagc

SEQ ID NO: 4795 - DNA, 17 bp, Artificial Sequence
  Synthetic Polynucleotide
agggcagagacaatctt

SEQ ID NO: 4796 - DNA, 19 bp, Artificial Sequence
  Synthetic Polynucleotide
ccaaggagaacatagtcaa

SEQ ID NO: 4797 - DNA, 20 bp, Artificial Sequence
  Synthetic Polynucleotide
caaaagtgaagtcagcactc

SEQ ID NO: 4798 - DNA, 17 bp, Artificial Sequence
  Synthetic Polynucleotide
tgttcgttgaggagaag

SEQ ID NO: 4799 - DNA, 19 bp, Artificial Sequence
  Synthetic Polynucleotide
atgcattcaaagaactcac

SEQ ID NO: 4800 - DNA, 19 bp, Artificial Sequence
  Synthetic Polynucleotide
tgaagccaatttctgagct

SEQ ID NO: 4801 - DNA, 18 bp, Artificial Sequence
  Synthetic Polynucleotide
ctggaatgagcaccctca

SEQ ID NO: 4802 - DNA, 17 bp, Artificial Sequence
  Synthetic Polynucleotide
tcagaccaatcatgctt

SEQ ID NO: 4803 - DNA, 19 bp, Artificial Sequence
  Synthetic Polynucleotide
agtagactccgagatagag

SEQ ID NO: 4804 - DNA, 18 bp, Artificial Sequence
  Synthetic Polynucleotide
ttgcatcatcaagaggta

SEQ ID NO: 4805 - DNA, 19 bp, Artificial Sequence
  Synthetic Polynucleotide
gagtttgaggaagatcaga

SEQ ID NO: 4806 - DNA, 17 bp, Artificial Sequence
  Synthetic Polynucleotide
gaaggtccagtcatctg

SEQ ID NO: 4807 - DNA, 18 bp, Artificial Sequence
  Synthetic Polynucleotide
gtgcaggaagcagatctt

SEQ ID NO: 4808 - DNA, 18 bp, Artificial Sequence
  Synthetic Polynucleotide
ccgcaagatgttaagaca

SEQ ID NO: 4809 - DNA, 19 bp, Artificial Sequence
  Synthetic Polynucleotide
agtatgaaacaagttgggg

SEQ ID NO: 4810 - DNA, 18 bp, Artificial Sequence
  Synthetic Polynucleotide
gcctccaccagagcatta

SEQ ID NO: 4811 - DNA, 19 bp, Artificial Sequence
  Synthetic Polynucleotide
gcatccctgtgtgatagag

SEQ ID NO: 4812 - DNA, 18 bp, Artificial Sequence
  Synthetic Polynucleotide
attcaggcagtgaacatc

SEQ ID NO: 4813 - DNA, 20 bp, Artificial Sequence
  Synthetic Polynucleotide
taagaataccagaagctatg

SEQ ID NO: 4814 - DNA, 18 bp, Artificial Sequence
  Synthetic Polynucleotide
gcaacaaaagcaaagctt

SEQ ID NO: 4815 - DNA, 18 bp, Artificial Sequence
  Synthetic Polynucleotide
ccatcattgtgcaaatct

SEQ ID NO: 4816 - DNA, 20 bp, Artificial Sequence
  Synthetic Polynucleotide
gaggtagtagaatcgtacac

SEQ ID NO: 4817 - DNA, 19 bp, Artificial Sequence
  Synthetic Polynucleotide
tggggtaggtaagtttact

SEQ ID NO: 4818 - DNA, 20 bp, Artificial Sequence
  Synthetic Polynucleotide
tcatccattgtaaatccttt

SEQ ID NO: 4819 - DNA, 18 bp, Artificial Sequence
  Synthetic Polynucleotide
atgtctaaggtcaagctc

SEQ ID NO: 4820 - DNA, 19 bp, Artificial Sequence
  Synthetic Polynucleotide
aaaagcctcgtaataagca

SEQ ID NO: 4821 - DNA, 17 bp, Artificial Sequence
  Synthetic Polynucleotide
tgctgccatgatactga

SEQ ID NO: 4822 - DNA, 19 bp, Artificial Sequence
  Synthetic Polynucleotide
tacaaaggttttcttcacc

SEQ ID NO: 4823 - DNA, 18 bp, Artificial Sequence
  Synthetic Polynucleotide
ggcattttcagaaggtgg

SEQ ID NO: 4824 - DNA, 19 bp, Artificial Sequence
  Synthetic Polynucleotide
tccaacgaatatctctcta

SEQ ID NO: 4825 - DNA, 18 bp, Artificial Sequence
  Synthetic Polynucleotide
agataaagagaggtgcca

SEQ ID NO: 4826 - DNA, 18 bp, Artificial Sequence
  Synthetic Polynucleotide
cacatcaaggacatttcc

SEQ ID NO: 4827 - DNA, 19 bp, Artificial Sequence
  Synthetic Polynucleotide
atgagccaactcagggaaa

SEQ ID NO: 4828 - DNA, 19 bp, Artificial Sequence
  Synthetic Polynucleotide
aagtaggacactctgttaa

SEQ ID NO: 4829 - DNA, 20 bp, Artificial Sequence
  Synthetic Polynucleotide
tgtgttcagtttggagaaga

SEQ ID NO: 4830 - DNA, 17 bp, Artificial Sequence
  Synthetic Polynucleotide
tagtagtatgctccgca

SEQ ID NO: 4831 - DNA, 19 bp, Artificial Sequence
  Synthetic Polynucleotide
ctgcatttcattgttatgg

SEQ ID NO: 4832 - DNA, 18 bp, Artificial Sequence
  Synthetic Polynucleotide
ctcggtgatagatggaaa

SEQ ID NO: 4833 - DNA, 18 bp, Artificial Sequence
  Synthetic Polynucleotide
attgctgttcctcgtgtg

SEQ ID NO: 4834 - DNA, 20 bp, Artificial Sequence
  Synthetic Polynucleotide
caattacattgatactgcct

SEQ ID NO: 4835 - DNA, 20 bp, Artificial Sequence
  Synthetic Polynucleotide
cagaatcaaaatctgcaacc

SEQ ID NO: 4836 - DNA, 18 bp, Artificial Sequence
  Synthetic Polynucleotide
tagtagtctaggtcacag

SEQ ID NO: 4837 - DNA, 19 bp, Artificial Sequence
  Synthetic Polynucleotide
tggccccattcaagaaact

SEQ ID NO: 4838 - DNA, 20 bp, Artificial Sequence
  Synthetic Polynucleotide
agatagatcccggtttacta

SEQ ID NO: 4839 - DNA, 18 bp, Artificial Sequence
  Synthetic Polynucleotide
ttgccacaaaagattcat

SEQ ID NO: 4840 - DNA, 19 bp, Artificial Sequence
  Synthetic Polynucleotide
ctcttggagaatcacaaaa

SEQ ID NO: 4841 - DNA, 19 bp, Artificial Sequence
  Synthetic Polynucleotide
ctagctgcaagaatgatag

SEQ ID NO: 4842 - DNA, 20 bp, Artificial Sequence
  Synthetic Polynucleotide
cattacttactgcatcaact

SEQ ID NO: 4843 - DNA, 19 bp, Artificial Sequence
  Synthetic Polynucleotide
gtattgaagtttggaggtg

SEQ ID NO: 4844 - DNA, 17 bp, Artificial Sequence
  Synthetic Polynucleotide
tgctgtttcaaccacta

SEQ ID NO: 4845 - DNA, 19 bp, Artificial Sequence
  Synthetic Polynucleotide
agtccagtttgtctgtatc

SEQ ID NO: 4846 - DNA, 19 bp, Artificial Sequence
  Synthetic Polynucleotide
tccgcaagatatagaaata

SEQ ID NO: 4847 - DNA, 19 bp, Artificial Sequence
  Synthetic Polynucleotide
catcatcaatagaaggtgc

SEQ ID NO: 4848 - DNA, 20 bp, Artificial Sequence
  Synthetic Polynucleotide
ttcttcataaatctgtcagc

SEQ ID NO: 4849 - DNA, 20 bp, Artificial Sequence
  Synthetic Polynucleotide
tacaaagaaactaaaggtga

SEQ ID NO: 4850 - DNA, 19 bp, Artificial Sequence
  Synthetic Polynucleotide
cttgtctactgtctaggtc

SEQ ID NO: 4851 - DNA, 17 bp, Artificial Sequence
  Synthetic Polynucleotide
tgagcttgattgttgct

SEQ ID NO: 4852 - DNA, 19 bp, Artificial Sequence
  Synthetic Polynucleotide
gcaatttcatcctatcaga

SEQ ID NO: 4853 - DNA, 20 bp, Artificial Sequence
  Synthetic Polynucleotide
gtcctaaacttaatctggtt

SEQ ID NO: 4854 - DNA, 20 bp, Artificial Sequence
  Synthetic Polynucleotide
aaaacattccgttgagttat

SEQ ID NO: 4855 - DNA, 18 bp, Artificial Sequence
  Synthetic Polynucleotide
tggtgaatgggtgacatt

SEQ ID NO: 4856 - DNA, 19 bp, Artificial Sequence
  Synthetic Polynucleotide
aaatctacagacccggtga

SEQ ID NO: 4857 - DNA, 20 bp, Artificial Sequence
  Synthetic Polynucleotide
ctgaagacatgatgcaattc

SEQ ID NO: 4858 - DNA, 17 bp, Artificial Sequence
  Synthetic Polynucleotide
caagtgctctcgaacat

SEQ ID NO: 4859 - DNA, 18 bp, Artificial Sequence
  Synthetic Polynucleotide
gataaagcatgactggtc

SEQ ID NO: 4860 - DNA, 17 bp, Artificial Sequence
  Synthetic Polynucleotide
aagatatcgttgccgca

SEQ ID NO: 4861 - DNA, 17 bp, Artificial Sequence
  Synthetic Polynucleotide
aaggacataggtttccg

SEQ ID NO: 4862 - DNA, 18 bp, Artificial Sequence
  Synthetic Polynucleotide
tgtgctccactgaataca

SEQ ID NO: 4863 - DNA, 20 bp, Artificial Sequence
  Synthetic Polynucleotide
agttaggatcttcttcctca

SEQ ID NO: 4864 - DNA, 18 bp, Artificial Sequence
  Synthetic Polynucleotide
gcaggttgatgatgtgca

SEQ ID NO: 4865 - DNA, 19 bp, Artificial Sequence
  Synthetic Polynucleotide
gctgtgaagtaatgatacc

SEQ ID NO: 4866 - DNA, 20 bp, Artificial Sequence
  Synthetic Polynucleotide
atgatgcctaaatcactcca

SEQ ID NO: 4867 - DNA, 19 bp, Artificial Sequence
  Synthetic Polynucleotide
gaacatcttttgttttgga

SEQ ID NO: 4868 - DNA, 18 bp, Artificial Sequence
  Synthetic Polynucleotide
attgacctcttcaaagga

SEQ ID NO: 4869 - DNA, 18 bp, Artificial Sequence
  Synthetic Polynucleotide
gcttgagcctgatgacca

SEQ ID NO: 4870 - DNA, 18 bp, Artificial Sequence
  Synthetic Polynucleotide
tcccacttaatatcccca

SEQ ID NO: 4871 - DNA, 20 bp, Artificial Sequence
  Synthetic Polynucleotide
attcaatattacagaacccc

SEQ ID NO: 4872 - DNA, 17 bp, Artificial Sequence
  Synthetic Polynucleotide
caagtgacctctccagg

SEQ ID NO: 4873 - DNA, 17 bp, Artificial Sequence
  Synthetic Polynucleotide
cacaaaggtccctagtt

SEQ ID NO: 4874 - DNA, 20 bp, Artificial Sequence
  Synthetic Polynucleotide
agcaagtacctccctgaatg

SEQ ID NO: 4875 - DNA, 17 bp, Artificial Sequence
  Synthetic Polynucleotide
tgcaaaggttgtgcctg

SEQ ID NO: 4876 - DNA, 20 bp, Artificial Sequence
  Synthetic Polynucleotide
ccaatatctccctaagcctg

SEQ ID NO: 4877 - DNA, 17 bp, Artificial Sequence
  Synthetic Polynucleotide
cattgactgtgctgaag

SEQ ID NO: 4878 - DNA, 17 bp, Artificial Sequence
  Synthetic Polynucleotide
catccctctcttggata

SEQ ID NO: 4879 - DNA, 20 bp, Artificial Sequence
  Synthetic Polynucleotide
atgcgaagaatttgggtgcc

SEQ ID NO: 4880 - DNA, 20 bp, Artificial Sequence
  Synthetic Polynucleotide
acacagtatgtcttttcata

SEQ ID NO: 4881 - DNA, 20 bp, Artificial Sequence
  Synthetic Polynucleotide
tagtagtagactccgcaaga

SEQ ID NO: 4882 - DNA, 19 bp, Artificial Sequence
  Synthetic Polynucleotide
tgtcaaatagattacgctg

SEQ ID NO: 4883 - DNA, 18 bp, Artificial Sequence
  Synthetic Polynucleotide
gaaggaacagagactgct

SEQ ID NO: 4884 - DNA, 19 bp, Artificial Sequence
  Synthetic Polynucleotide
caaatctggcaactacaag

SEQ ID NO: 4885 - DNA, 20 bp, Artificial Sequence
  Synthetic Polynucleotide
gttccatgaattgcacctgt

SEQ ID NO: 4886 - DNA, 19 bp, Artificial Sequence
  Synthetic Polynucleotide
tttgactccttagtttcca

SEQ ID NO: 4887 - DNA, 20 bp, Artificial Sequence
  Synthetic Polynucleotide
acaatcattgtttacctgac

SEQ ID NO: 4888 - DNA, 17 bp, Artificial Sequence
  Synthetic Polynucleotide
ggttgactgggctttga

SEQ ID NO: 4889 - DNA, 20 bp, Artificial Sequence
  Synthetic Polynucleotide
cgctcgaattttcttcctca

SEQ ID NO: 4890 - DNA, 19 bp, Artificial Sequence
  Synthetic Polynucleotide
tcactggcaagtactcctg

SEQ ID NO: 4891 - DNA, 18 bp, Artificial Sequence
  Synthetic Polynucleotide
gagggtgatagctcttgt

SEQ ID NO: 4892 - DNA, 19 bp, Artificial Sequence
  Synthetic Polynucleotide
tgtttaaagatgatcccgc

SEQ ID NO: 4893 - DNA, 17 bp, Artificial Sequence
  Synthetic Polynucleotide
tgtggatacctctcagg

SEQ ID NO: 4894 - DNA, 18 bp, Artificial Sequence
  Synthetic Polynucleotide
tgattttgtgaaccagca

SEQ ID NO: 4895 - DNA, 18 bp, Artificial Sequence
  Synthetic Polynucleotide
gcaagctcacttgaatgg

SEQ ID NO: 4896 - DNA, 20 bp, Artificial Sequence
  Synthetic Polynucleotide
cttttctccaccatactaac

SEQ ID NO: 4897 - DNA, 19 bp, Artificial Sequence
  Synthetic Polynucleotide
tgaaaccgaagatgcaaca

SEQ ID NO: 4898 - DNA, 20 bp, Artificial Sequence
  Synthetic Polynucleotide
attccaaggcaatcctatta

SEQ ID NO: 4899 - DNA, 19 bp, Artificial Sequence
  Synthetic Polynucleotide
gttccatgaacattttggc

SEQ ID NO: 4900 - DNA, 18 bp, Artificial Sequence
  Synthetic Polynucleotide
ctttccccatttcagagg

SEQ ID NO: 4901 - DNA, 17 bp, Artificial Sequence
  Synthetic Polynucleotide
aggttagcatgaggctt

SEQ ID NO: 4902 - DNA, 18 bp, Artificial Sequence
  Synthetic Polynucleotide
cagatgactggactttta

SEQ ID NO: 4903 - DNA, 19 bp, Artificial Sequence
  Synthetic Polynucleotide
ctttgaatacatctcctgc

SEQ ID NO: 4904 - DNA, 17 bp, Artificial Sequence
  Synthetic Polynucleotide
gcatccatccaatgacc

SEQ ID NO: 4905 - DNA, 17 bp, Artificial Sequence
  Synthetic Polynucleotide
tcagacacattgtcagc

SEQ ID NO: 4906 - DNA, 20 bp, Artificial Sequence
  Synthetic Polynucleotide
atggttatcctttactcctg

SEQ ID NO: 4907 - DNA, 20 bp, Artificial Sequence
  Synthetic Polynucleotide
gcaactataactttaagggc

SEQ ID NO: 4908 - DNA, 20 bp, Artificial Sequence
  Synthetic Polynucleotide
ttttactgtcccatgttggt

SEQ ID NO: 4909 - DNA, 18 bp, Artificial Sequence
  Synthetic Polynucleotide
tccatttacaacttctgc

SEQ ID NO: 4910 - DNA, 18 bp, Artificial Sequence
  Synthetic Polynucleotide
tactccttgaaaagcaat

SEQ ID NO: 4911 - DNA, 18 bp, Artificial Sequence
  Synthetic Polynucleotide
ggaccccgatgatgttaa

SEQ ID NO: 4912 - DNA, 17 bp, Artificial Sequence
  Synthetic Polynucleotide
gtgtgtttgcgtgtgaa

SEQ ID NO: 4913 - DNA, 19 bp, Artificial Sequence
  Synthetic Polynucleotide
tggttaaacttgtccctaa

SEQ ID NO: 4914 - DNA, 17 bp, Artificial Sequence
  Synthetic Polynucleotide
cctacaccagaacccca

SEQ ID NO: 4915 - DNA, 20 bp, Artificial Sequence
  Synthetic Polynucleotide
accagtatgtgagtatcaag

SEQ ID NO: 4916 - DNA, 20 bp, Artificial Sequence
  Synthetic Polynucleotide
tgagatgttgcccatactta

SEQ ID NO: 4917 - DNA, 20 bp, Artificial Sequence
  Synthetic Polynucleotide
agtagtgtactccactatta

SEQ ID NO: 4918 - DNA, 20 bp, Artificial Sequence
  Synthetic Polynucleotide
atgatatccttggcatttta

SEQ ID NO: 4919 - DNA, 20 bp, Artificial Sequence
  Synthetic Polynucleotide
atctgctacagttgtatcta

SEQ ID NO: 4920 - DNA, 19 bp, Artificial Sequence
  Synthetic Polynucleotide
acatccatgttttgcacct

SEQ ID NO: 4921 - DNA, 20 bp, Artificial Sequence
  Synthetic Polynucleotide
cagaaataccagcattagca

SEQ ID NO: 4922 - DNA, 19 bp, Artificial Sequence
  Synthetic Polynucleotide
aaccaatcagttccatcat

SEQ ID NO: 4923 - DNA, 19 bp, Artificial Sequence
  Synthetic Polynucleotide
gtcatgagtattgacttga

SEQ ID NO: 4924 - DNA, 18 bp, Artificial Sequence
  Synthetic Polynucleotide
tgctccaccaattcttaa

SEQ ID NO: 4925 - DNA, 19 bp, Artificial Sequence
  Synthetic Polynucleotide
cagtccattccactgcctg

SEQ ID NO: 4926 - DNA, 18 bp, Artificial Sequence
  Synthetic Polynucleotide
gcatgtttggatctacca

SEQ ID NO: 4927 - DNA, 20 bp, Artificial Sequence
  Synthetic Polynucleotide
gtgcatcagaaatattacct

SEQ ID NO: 4928 - DNA, 17 bp, Artificial Sequence
  Synthetic Polynucleotide
accacccacccattttg

SEQ ID NO: 4929 - DNA, 17 bp, Artificial Sequence
  Synthetic Polynucleotide
atcttaccttgcaccgg

SEQ ID NO: 4930 - DNA, 19 bp, Artificial Sequence
  Synthetic Polynucleotide
ggcctcgatgtcttacgta

SEQ ID NO: 4931 - DNA, 17 bp, Artificial Sequence
  Synthetic Polynucleotide
tcaacgatgtaccacaa

SEQ ID NO: 4932 - DNA, 18 bp, Artificial Sequence
  Synthetic Polynucleotide
gaaacatttcagctccag

SEQ ID NO: 4933 - DNA, 17 bp, Artificial Sequence
  Synthetic Polynucleotide
tttcttcctcaaccaga

SEQ ID NO: 4934 - DNA, 18 bp, Artificial Sequence
  Synthetic Polynucleotide
tctgtaccttctattgca

SEQ ID NO: 4935 - DNA, 20 bp, Artificial Sequence
  Synthetic Polynucleotide
tacaaattagatgagttgcc

SEQ ID NO: 4936 - DNA, 18 bp, Artificial Sequence
  Synthetic Polynucleotide
ccatccagatttcacagt

SEQ ID NO: 4937 - DNA, 20 bp, Artificial Sequence
  Synthetic Polynucleotide
aaactaactcctatgtctgt

SEQ ID NO: 4938 - DNA, 20 bp, Artificial Sequence
  Synthetic Polynucleotide
agtgtgctccacctaatact

SEQ ID NO: 4939 - DNA, 19 bp, Artificial Sequence
  Synthetic Polynucleotide
ctttctttcctggctctga

SEQ ID NO: 4940 - DNA, 17 bp, Artificial Sequence
  Synthetic Polynucleotide
ttgtagcccagccatga

SEQ ID NO: 4941 - DNA, 20 bp, Artificial Sequence
  Synthetic Polynucleotide
atccaagaggtgaagatcat

SEQ ID NO: 4942 - DNA, 18 bp, Artificial Sequence
  Synthetic Polynucleotide
acccagccaaagcaaaat

SEQ ID NO: 4943 - DNA, 20 bp, Artificial Sequence
  Synthetic Polynucleotide
gtctatgaaaggacatactg

SEQ ID NO: 4944 - DNA, 17 bp, Artificial Sequence
  Synthetic Polynucleotide
tcccttctgtcagtatc

SEQ ID NO: 4945 - DNA, 17 bp, Artificial Sequence
  Synthetic Polynucleotide
gaggcagaacagcttgt

SEQ ID NO: 4946 - DNA, 19 bp, Artificial Sequence
  Synthetic Polynucleotide
gttgttgttagtaagcaga

SEQ ID NO: 4947 - DNA, 19 bp, Artificial Sequence
  Synthetic Polynucleotide
gcaggttgtagcatgattg

SEQ ID NO: 4948 - DNA, 18 bp, Artificial Sequence
  Synthetic Polynucleotide
agatgcagagaacgaaga

SEQ ID NO: 4949 - DNA, 19 bp, Artificial Sequence
  Synthetic Polynucleotide
tctgaccatcagcttagag

SEQ ID NO: 4950 - DNA, 17 bp, Artificial Sequence
  Synthetic Polynucleotide
tcattctgtccgatgtt

SEQ ID NO: 4951 - DNA, 20 bp, Artificial Sequence
  Synthetic Polynucleotide
gaatcgtacatttgtagtgc

SEQ ID NO: 4952 - DNA, 19 bp, Artificial Sequence
  Synthetic Polynucleotide
cttcccacaaactcctagg

SEQ ID NO: 4953 - DNA, 17 bp, Artificial Sequence
  Synthetic Polynucleotide
agggacatctttgagga

SEQ ID NO: 4954 - DNA, 18 bp, Artificial Sequence
  Synthetic Polynucleotide
tcagtctgaatcccagtt

SEQ ID NO: 4955 - DNA, 20 bp, Artificial Sequence
  Synthetic Polynucleotide
caaggatcacattagccaga

SEQ ID NO: 4956 - DNA, 19 bp, Artificial Sequence
  Synthetic Polynucleotide
gacatctgagaagtgtttc

SEQ ID NO: 4957 - DNA, 20 bp, Artificial Sequence
  Synthetic Polynucleotide
aattatgaccacatacgaat

SEQ ID NO: 4958 - DNA, 18 bp, Artificial Sequence
  Synthetic Polynucleotide
agacacaatatgagccac

SEQ ID NO: 4959 - DNA, 19 bp, Artificial Sequence
  Synthetic Polynucleotide
cttttagcagtcactcaac

SEQ ID NO: 4960 - DNA, 17 bp, Artificial Sequence
  Synthetic Polynucleotide
accatgtctaacgtcag

SEQ ID NO: 4961 - DNA, 20 bp, Artificial Sequence
  Synthetic Polynucleotide
acatgaatcaaacagagcag

SEQ ID NO: 4962 - DNA, 18 bp, Artificial Sequence
  Synthetic Polynucleotide
aagtcttccagagaccat

SEQ ID NO: 4963 - DNA, 19 bp, Artificial Sequence
  Synthetic Polynucleotide
tatcaacgcacaatgaagt

SEQ ID NO: 4964 - DNA, 19 bp, Artificial Sequence
  Synthetic Polynucleotide
atgaagtctagataccacc

SEQ ID NO: 4965 - DNA, 19 bp, Artificial Sequence
  Synthetic Polynucleotide
ttctgtagggtgaatttct

SEQ ID NO: 4966 - DNA, 20 bp, Artificial Sequence
  Synthetic Polynucleotide
tgttccacattctgtaaggc

SEQ ID NO: 4967 - DNA, 20 bp, Artificial Sequence
  Synthetic Polynucleotide
gtgaaccacatatcacagct

SEQ ID NO: 4968 - DNA, 19 bp, Artificial Sequence
  Synthetic Polynucleotide
cccatatcgtctattgtca

SEQ ID NO: 4969 - DNA, 18 bp, Artificial Sequence
  Synthetic Polynucleotide
atgcaaaagccagcgacc

SEQ ID NO: 4970 - DNA, 20 bp, Artificial Sequence
  Synthetic Polynucleotide
taacaatttcaggcccagta

SEQ ID NO: 4971 - DNA, 20 bp, Artificial Sequence
  Synthetic Polynucleotide
ggcacttctggatatgtctt

SEQ ID NO: 4972 - DNA, 18 bp, Artificial Sequence
  Synthetic Polynucleotide
tgcgatatgttgaatccc

SEQ ID NO: 4973 - DNA, 18 bp, Artificial Sequence
  Synthetic Polynucleotide
taatcccaaaggcgtcag

SEQ ID NO: 4974 - DNA, 20 bp, Artificial Sequence
  Synthetic Polynucleotide
cactgtattttgacctctta

SEQ ID NO: 4975 - DNA, 20 bp, Artificial Sequence
  Synthetic Polynucleotide
acttgaaggtggtggtctaa

SEQ ID NO: 4976 - DNA, 19 bp, Artificial Sequence
  Synthetic Polynucleotide
tcgttgtcgattgatccac

SEQ ID NO: 4977 - DNA, 18 bp, Artificial Sequence
  Synthetic Polynucleotide
tggatgtgattgacaaga

SEQ ID NO: 4978 - DNA, 17 bp, Artificial Sequence
  Synthetic Polynucleotide
ggggaaagctaacgggg

SEQ ID NO: 4979 - DNA, 20 bp, Artificial Sequence
  Synthetic Polynucleotide
ttcgaatacattttgaccct

SEQ ID NO: 4980 - DNA, 18 bp, Artificial Sequence
  Synthetic Polynucleotide
tcagagctagaatgctcg

SEQ ID NO: 4981 - DNA, 18 bp, Artificial Sequence
  Synthetic Polynucleotide
ttgcaatcctacctgtgt

SEQ ID NO: 4982 - DNA, 17 bp, Artificial Sequence
  Synthetic Polynucleotide
tttcctgtcagtggagc

SEQ ID NO: 4983 - DNA, 20 bp, Artificial Sequence
  Synthetic Polynucleotide
catcaactattcttgagcct

SEQ ID NO: 4984 - DNA, 20 bp, Artificial Sequence
  Synthetic Polynucleotide
tggagtggtttgatgtgtta

SEQ ID NO: 4985 - DNA, 20 bp, Artificial Sequence
  Synthetic Polynucleotide
gcacgtcagttcgtaagtat

SEQ ID NO: 4986 - DNA, 20 bp, Artificial Sequence
  Synthetic Polynucleotide
cattgaacccattgtcttct

SEQ ID NO: 4987 - DNA, 19 bp, Artificial Sequence
  Synthetic Polynucleotide
atggaggggtttcttatca

SEQ ID NO: 4988 - DNA, 18 bp, Artificial Sequence
  Synthetic Polynucleotide
atggtgtgatctgaacaa

SEQ ID NO: 4989 - DNA, 17 bp, Artificial Sequence
  Synthetic Polynucleotide
ggtcacggagtgtaaaa

SEQ ID NO: 4990 - DNA, 19 bp, Artificial Sequence
  Synthetic Polynucleotide
gtctcccatgttgcagtag

SEQ ID NO: 4991 - DNA, 19 bp, Artificial Sequence
  Synthetic Polynucleotide
ggtagtaacgtaccaagtc

SEQ ID NO: 4992 - DNA, 20 bp, Artificial Sequence
  Synthetic Polynucleotide
ctttgtttgtgagtagccac

SEQ ID NO: 4993 - DNA, 19 bp, Artificial Sequence
  Synthetic Polynucleotide
aacatctgatagaatgcga

SEQ ID NO: 4994 - DNA, 18 bp, Artificial Sequence
  Synthetic Polynucleotide
tcttcttcttcagccagt

SEQ ID NO: 4995 - DNA, 20 bp, Artificial Sequence
  Synthetic Polynucleotide
tgttttagttgcacttctgg

SEQ ID NO: 4996 - DNA, 19 bp, Artificial Sequence
  Synthetic Polynucleotide
cctcttgctagatttgctg

SEQ ID NO: 4997 - DNA, 20 bp, Artificial Sequence
  Synthetic Polynucleotide
ctgctaactctttagaatgg

SEQ ID NO: 4998 - DNA, 19 bp, Artificial Sequence
  Synthetic Polynucleotide
gcctcagttctttgatatt

SEQ ID NO: 4999 - DNA, 19 bp, Artificial Sequence
  Synthetic Polynucleotide
tatgcttatggcagtgtac

SEQ ID NO: 5000 - DNA, 17 bp, Artificial Sequence
  Synthetic Polynucleotide
atgggttttgcacactg

SEQ ID NO: 5001 - DNA, 17 bp, Artificial Sequence
  Synthetic Polynucleotide
gacatgatcagacgcag

SEQ ID NO: 5002 - DNA, 18 bp, Artificial Sequence
  Synthetic Polynucleotide
gtagttctcctctgaaga

SEQ ID NO: 5003 - DNA, 19 bp, Artificial Sequence
  Synthetic Polynucleotide
acacagaagcatacatttg

SEQ ID NO: 5004 - DNA, 19 bp, Artificial Sequence
  Synthetic Polynucleotide
cccttatgtctttctcttg

SEQ ID NO: 5005 - DNA, 19 bp, Artificial Sequence
  Synthetic Polynucleotide
caccattttaggccgctaa

SEQ ID NO: 5006 - DNA, 20 bp, Artificial Sequence
  Synthetic Polynucleotide
tcaaacctcacttagaaaat

SEQ ID NO: 5007 - DNA, 17 bp, Artificial Sequence
  Synthetic Polynucleotide
agctttaccagatgcag

SEQ ID NO: 5008 - DNA, 18 bp, Artificial Sequence
  Synthetic Polynucleotide
tacaagcacatttatccg

SEQ ID NO: 5009 - DNA, 18 bp, Artificial Sequence
  Synthetic Polynucleotide
gtgaactcctgttttgtc

SEQ ID NO: 5010 - DNA, 20 bp, Artificial Sequence
  Synthetic Polynucleotide
ttatctagtcttcccggttt

SEQ ID NO: 5011 - DNA, 18 bp, Artificial Sequence
  Synthetic Polynucleotide
catctgttgattccagta

SEQ ID NO: 5012 - DNA, 18 bp, Artificial Sequence
  Synthetic Polynucleotide
gctcatgcaattttgact

SEQ ID NO: 5013 - DNA, 19 bp, Artificial Sequence
  Synthetic Polynucleotide
acttgaactcgactatcca

SEQ ID NO: 5014 - DNA, 18 bp, Artificial Sequence
  Synthetic Polynucleotide
agagattcccgtgtatta

SEQ ID NO: 5015 - DNA, 20 bp, Artificial Sequence
  Synthetic Polynucleotide
aagacctcccgtattgctaa

SEQ ID NO: 5016 - DNA, 18 bp, Artificial Sequence
  Synthetic Polynucleotide
tctgctttcacaatgaag

SEQ ID NO: 5017 - DNA, 19 bp, Artificial Sequence
  Synthetic Polynucleotide
cccttgaagttcttcctaa

SEQ ID NO: 5018 - DNA, 17 bp, Artificial Sequence
  Synthetic Polynucleotide
ccctgtaggttcatcaa

SEQ ID NO: 5019 - DNA, 18 bp, Artificial Sequence
  Synthetic Polynucleotide
tcctgacgacctgaataa

SEQ ID NO: 5020 - DNA, 18 bp, Artificial Sequence
  Synthetic Polynucleotide
tttgtccttaggttgaga

SEQ ID NO: 5021 - DNA, 18 bp, Artificial Sequence
  Synthetic Polynucleotide
ttcccaactgtttcacag

SEQ ID NO: 5022 - DNA, 17 bp, Artificial Sequence
  Synthetic Polynucleotide
tcactatccagaacgag

SEQ ID NO: 5023 - DNA, 18 bp, Artificial Sequence
  Synthetic Polynucleotide
gctcgattcttctccaga

SEQ ID NO: 5024 - DNA, 18 bp, Artificial Sequence
  Synthetic Polynucleotide
gtcagccaattttgttta

SEQ ID NO: 5025 - DNA, 20 bp, Artificial Sequence
  Synthetic Polynucleotide
aacacacacactcgacatat

SEQ ID NO: 5026 - DNA, 18 bp, Artificial Sequence
  Synthetic Polynucleotide
ggtaatgactccctttgc

SEQ ID NO: 5027 - DNA, 17 bp, Artificial Sequence
  Synthetic Polynucleotide
agcagtttccagccatg

SEQ ID NO: 5028 - DNA, 20 bp, Artificial Sequence
  Synthetic Polynucleotide
tcttttcatctattccaagc

SEQ ID NO: 5029 - DNA, 20 bp, Artificial Sequence
  Synthetic Polynucleotide
ctcagcactcagtaagatat

SEQ ID NO: 5030 - DNA, 17 bp, Artificial Sequence
  Synthetic Polynucleotide
gggaagaaccacttcat

SEQ ID NO: 5031 - DNA, 17 bp, Artificial Sequence
  Synthetic Polynucleotide
tgaatgaagatggcgtc

SEQ ID NO: 5032 - DNA, 17 bp, Artificial Sequence
  Synthetic Polynucleotide
attcccatgtaggaggc

SEQ ID NO: 5033 - DNA, 18 bp, Artificial Sequence
  Synthetic Polynucleotide
gcgctaacgtgcttaaat

SEQ ID NO: 5034 - DNA, 17 bp, Artificial Sequence
  Synthetic Polynucleotide
gagtcccactttgagta

SEQ ID NO: 5035 - DNA, 17 bp, Artificial Sequence
  Synthetic Polynucleotide
caccttgtcaaccttgc

SEQ ID NO: 5036 - DNA, 18 bp, Artificial Sequence
  Synthetic Polynucleotide
ctttccccttgatgtagt

SEQ ID NO: 5037 - DNA, 17 bp, Artificial Sequence
  Synthetic Polynucleotide
gtcccaaaatggtgctt

SEQ ID NO: 5038 - DNA, 17 bp, Artificial Sequence
  Synthetic Polynucleotide
gggtaattgctggtgca

SEQ ID NO: 5039 - DNA, 17 bp, Artificial Sequence
  Synthetic Polynucleotide
caccgattcgctcaccg

SEQ ID NO: 5040 - DNA, 17 bp, Artificial Sequence
  Synthetic Polynucleotide
gttgaattgctgcccca

SEQ ID NO: 5041 - DNA, 17 bp, Artificial Sequence
  Synthetic Polynucleotide
tcttcttgatgtgcgtc

SEQ ID NO: 5042 - DNA, 17 bp, Artificial Sequence
  Synthetic Polynucleotide
cgcattcccatgtaggt

SEQ ID NO: 5043 - DNA, 18 bp, Artificial Sequence
  Synthetic Polynucleotide
gcttgttgctgaacccca

SEQ ID NO: 5044 - DNA, 17 bp, Artificial Sequence
  Synthetic Polynucleotide
ccatagtcgtcccacag

SEQ ID NO: 5045 - DNA, 17 bp, Artificial Sequence
  Synthetic Polynucleotide
cccacctgatgtttcca

SEQ ID NO: 5046 - DNA, 18 bp, Artificial Sequence
  Synthetic Polynucleotide
ggagtccaaaacaccttt

SEQ ID NO: 5047 - DNA, 17 bp, Artificial Sequence
  Synthetic Polynucleotide
gtgcctgccaacggata

SEQ ID NO: 5048 - DNA, 17 bp, Artificial Sequence
  Synthetic Polynucleotide
atgtagccctcgtagaa

SEQ ID NO: 5049 - DNA, 19 bp, Artificial Sequence
  Synthetic Polynucleotide
aaaagctagtgatccagat

SEQ ID NO: 5050 - DNA, 20 bp, Artificial Sequence
  Synthetic Polynucleotide
ttcctgtaaaacttttcccc

SEQ ID NO: 5051 - DNA, 19 bp, Artificial Sequence
  Synthetic Polynucleotide
ggtcatatgctgatgcttg

SEQ ID NO: 5052 - DNA, 20 bp, Artificial Sequence
  Synthetic Polynucleotide
gtaaaattgattcacccaag

SEQ ID NO: 5053 - DNA, 18 bp, Artificial Sequence
  Synthetic Polynucleotide
ttgactttcctgagaagg

SEQ ID NO: 5054 - DNA, 20 bp, Artificial Sequence
  Synthetic Polynucleotide
tcatttctaaccccaccttt

SEQ ID NO: 5055 - DNA, 19 bp, Artificial Sequence
  Synthetic Polynucleotide
tgactgctcccacctaaaa

SEQ ID NO: 5056 - DNA, 20 bp, Artificial Sequence
  Synthetic Polynucleotide
cactcatcatactcatcatc

SEQ ID NO: 5057 - DNA, 17 bp, Artificial Sequence
  Synthetic Polynucleotide
atccttgagtcctgcta

SEQ ID NO: 5058 - DNA, 18 bp, Artificial Sequence
  Synthetic Polynucleotide
gagtccatacgatgtcag

SEQ ID NO: 5059 - DNA, 19 bp, Artificial Sequence
  Synthetic Polynucleotide
tgggattccacacaaaatc

SEQ ID NO: 5060 - DNA, 17 bp, Artificial Sequence
  Synthetic Polynucleotide
cgtgatccaaaggttgc

SEQ ID NO: 5061 - DNA, 18 bp, Artificial Sequence
  Synthetic Polynucleotide
tactccaccgattcgctc

SEQ ID NO: 5062 - DNA, 19 bp, Artificial Sequence
  Synthetic Polynucleotide
ctgatcttcttgtactcct

SEQ ID NO: 5063 - DNA, 17 bp, Artificial Sequence
  Synthetic Polynucleotide
cagttcgtctctgatgc

SEQ ID NO: 5064 - DNA, 17 bp, Artificial Sequence
  Synthetic Polynucleotide
cgcgtaaccagggaaag

SEQ ID NO: 5065 - DNA, 17 bp, Artificial Sequence
  Synthetic Polynucleotide
aatagtgccgtgagtgc

SEQ ID NO: 5066 - DNA, 18 bp, Artificial Sequence
  Synthetic Polynucleotide
tcacaaattagttctgcc

SEQ ID NO: 5067 - DNA, 19 bp, Artificial Sequence
  Synthetic Polynucleotide
tgatggatgctggattcag

SEQ ID NO: 5068 - DNA, 20 bp, Artificial Sequence
  Synthetic Polynucleotide
aatatcaccttctgtttgcg

SEQ ID NO: 5069 - DNA, 18 bp, Artificial Sequence
  Synthetic Polynucleotide
tatcaggttcaggctagt

SEQ ID NO: 5070 - DNA, 17 bp, Artificial Sequence
  Synthetic Polynucleotide
gtacataccgttgccga

SEQ ID NO: 5071 - DNA, 17 bp, Artificial Sequence
  Synthetic Polynucleotide
ggatggttccacacttt

SEQ ID NO: 5072 - DNA, 19 bp, Artificial Sequence
  Synthetic Polynucleotide
gtcctgctataaaagctcc

SEQ ID NO: 5073 - DNA, 17 bp, Artificial Sequence
  Synthetic Polynucleotide
cagggttttgaccaggc

SEQ ID NO: 5074 - DNA, 18 bp, Artificial Sequence
  Synthetic Polynucleotide
ctcactgacctgagccat

SEQ ID NO: 5075 - DNA, 18 bp, Artificial Sequence
  Synthetic Polynucleotide
tgcatcaggaaactttgg

SEQ ID NO: 5076 - DNA, 17 bp, Artificial Sequence
  Synthetic Polynucleotide
gttgtaccaccaaccat

SEQ ID NO: 5077 - DNA, 17 bp, Artificial Sequence
  Synthetic Polynucleotide
gctgcatacagagacct

SEQ ID NO: 5078 - DNA, 17 bp, Artificial Sequence
  Synthetic Polynucleotide
agccatcaacggatttg

SEQ ID NO: 5079 - DNA, 20 bp, Artificial Sequence
  Synthetic Polynucleotide
aagaaagcacaactcttcaa

SEQ ID NO: 5080 - DNA, 18 bp, Artificial Sequence
  Synthetic Polynucleotide
gcataagcacagatcttt

SEQ ID NO: 5081 - DNA, 19 bp, Artificial Sequence
  Synthetic Polynucleotide
cctgccatatttcaacgaa

SEQ ID NO: 5082 - DNA, 19 bp, Artificial Sequence
  Synthetic Polynucleotide
gctcttcacagaacttctt

SEQ ID NO: 5083 - DNA, 18 bp, Artificial Sequence
  Synthetic Polynucleotide
caccatcagtcccagaag

SEQ ID NO: 5084 - DNA, 20 bp, Artificial Sequence
  Synthetic Polynucleotide
ctgatcccatccaatcatcg

SEQ ID NO: 5085 - DNA, 20 bp, Artificial Sequence
  Synthetic Polynucleotide
ttcatctgatttcccttacc

SEQ ID NO: 5086 - DNA, 20 bp, Artificial Sequence
  Synthetic Polynucleotide
tactcctgtcaagataatcc

SEQ ID NO: 5087 - DNA, 20 bp, Artificial Sequence
  Synthetic Polynucleotide
acaagggcactatatcccgt

SEQ ID NO: 5088 - DNA, 20 bp, Artificial Sequence
  Synthetic Polynucleotide
gacagaatcacaagtaagcc

SEQ ID NO: 5089 - DNA, 20 bp, Artificial Sequence
  Synthetic Polynucleotide
ttcattatgcctcaacaaat

SEQ ID NO: 5090 - DNA, 19 bp, Artificial Sequence
  Synthetic Polynucleotide
tggattttcgccatatata

SEQ ID NO: 5091 - DNA, 20 bp, Artificial Sequence
  Synthetic Polynucleotide
cttcatggaaaccacataaa

SEQ ID NO: 5092 - DNA, 20 bp, Artificial Sequence
  Synthetic Polynucleotide
cagaactttgtatccaagat

SEQ ID NO: 5093 - DNA, 17 bp, Artificial Sequence
  Synthetic Polynucleotide
cgaaaacgctaaccaag

SEQ ID NO: 5094 - DNA, 19 bp, Artificial Sequence
  Synthetic Polynucleotide
gtacctccgcatcaatagt

SEQ ID NO: 5095 - DNA, 19 bp, Artificial Sequence
  Synthetic Polynucleotide
gaccaatactccctcccag

SEQ ID NO: 5096 - DNA, 20 bp, Artificial Sequence
  Synthetic Polynucleotide
gtaatcacctgttttaccgc

SEQ ID NO: 5097 - DNA, 18 bp, Artificial Sequence
  Synthetic Polynucleotide
attcacatgtccacaagg

SEQ ID NO: 5098 - DNA, 20 bp, Artificial Sequence
  Synthetic Polynucleotide
aacttctcctgtcattagtc

SEQ ID NO: 5099 - DNA, 17 bp, Artificial Sequence
  Synthetic Polynucleotide
tccagcaactaccaagt

SEQ ID NO: 5100 - DNA, 17 bp, Artificial Sequence
  Synthetic Polynucleotide
tcttcgccagatacttc

SEQ ID NO: 5101 - DNA, 19 bp, Artificial Sequence
  Synthetic Polynucleotide
tcatcaaaggactactccc

SEQ ID NO: 5102 - DNA, 20 bp, Artificial Sequence
  Synthetic Polynucleotide
atgctaaagaaaagcatcga

SEQ ID NO: 5103 - DNA, 18 bp, Artificial Sequence
  Synthetic Polynucleotide
acctctatcaacacactg

SEQ ID NO: 5104 - DNA, 19 bp, Artificial Sequence
  Synthetic Polynucleotide
tcgattccactttcctgtt

SEQ ID NO: 5105 - DNA, 20 bp, Artificial Sequence
  Synthetic Polynucleotide
gctttgtagacacgggagca

SEQ ID NO: 5106 - DNA, 19 bp, Artificial Sequence
  Synthetic Polynucleotide
gcatcagggagactgtttg

SEQ ID NO: 5107 - DNA, 20 bp, Artificial Sequence
  Synthetic Polynucleotide
atcaaggctattgttgagaa

SEQ ID NO: 5108 - DNA, 20 bp, Artificial Sequence
  Synthetic Polynucleotide
atcattctttggaaatgacg

SEQ ID NO: 5109 - DNA, 19 bp, Artificial Sequence
  Synthetic Polynucleotide
ctccaagaccttaacaaga

SEQ ID NO: 5110 - DNA, 17 bp, Artificial Sequence
  Synthetic Polynucleotide
aagtttgttgcctgcta

SEQ ID NO: 5111 - DNA, 19 bp, Artificial Sequence
  Synthetic Polynucleotide
ggccaagaagggcattatg

SEQ ID NO: 5112 - DNA, 17 bp, Artificial Sequence
  Synthetic Polynucleotide
aactcagggttggttga

SEQ ID NO: 5113 - DNA, 20 bp, Artificial Sequence
  Synthetic Polynucleotide
gaaatctgtgccagaaaagc

SEQ ID NO: 5114 - DNA, 20 bp, Artificial Sequence
  Synthetic Polynucleotide
tgctgaaatagttgagaaaa

SEQ ID NO: 5115 - DNA, 18 bp, Artificial Sequence
  Synthetic Polynucleotide
aactaactacttgacgca

SEQ ID NO: 5116 - DNA, 18 bp, Artificial Sequence
  Synthetic Polynucleotide
ggaattgggctgtaagta

SEQ ID NO: 5117 - DNA, 19 bp, Artificial Sequence
  Synthetic Polynucleotide
tctgtaatggatgaaaagg

SEQ ID NO: 5118 - DNA, 20 bp, Artificial Sequence
  Synthetic Polynucleotide
tagattagagggtttctttt

SEQ ID NO: 5119 - DNA, 20 bp, Artificial Sequence
  Synthetic Polynucleotide
cattcatggatgttctagat

SEQ ID NO: 5120 - DNA, 19 bp, Artificial Sequence
  Synthetic Polynucleotide
tattctttcaaacgggttt

SEQ ID NO: 5121 - DNA, 19 bp, Artificial Sequence
  Synthetic Polynucleotide
aagtcagagctaagcgaaa

SEQ ID NO: 5122 - DNA, 19 bp, Artificial Sequence
  Synthetic Polynucleotide
ccaccaaagcacgacacag

SEQ ID NO: 5123 - DNA, 17 bp, Artificial Sequence
  Synthetic Polynucleotide
ctcagggtcacgaaacg

SEQ ID NO: 5124 - DNA, 17 bp, Artificial Sequence
  Synthetic Polynucleotide
caatagcatacgtcacg

SEQ ID NO: 5125 - DNA, 20 bp, Artificial Sequence
  Synthetic Polynucleotide
aacaacaaacaacaacaaca

SEQ ID NO: 5126 - DNA, 19 bp, Artificial Sequence
  Synthetic Polynucleotide
aatctgttccgccgttacg

SEQ ID NO: 5127 - DNA, 17 bp, Artificial Sequence
  Synthetic Polynucleotide
gatggtagacagaggct

SEQ ID NO: 5128 - DNA, 19 bp, Artificial Sequence
  Synthetic Polynucleotide
ggttctactatccacacca

SEQ ID NO: 5129 - DNA, 20 bp, Artificial Sequence
  Synthetic Polynucleotide
ggtggctataacacattggg

SEQ ID NO: 5130 - DNA, 17 bp, Artificial Sequence
  Synthetic Polynucleotide
gtccatgctctccgcta

SEQ ID NO: 5131 - DNA, 19 bp, Artificial Sequence
  Synthetic Polynucleotide
acaagacaataagaccaca

SEQ ID NO: 5132 - DNA, 19 bp, Artificial Sequence
  Synthetic Polynucleotide
tatgcgatctcacactctc

SEQ ID NO: 5133 - DNA, 19 bp, Artificial Sequence
  Synthetic Polynucleotide
cggacaacccgtatcatga

SEQ ID NO: 5134 - DNA, 19 bp, Artificial Sequence
  Synthetic Polynucleotide
aaaacacagtactaacacg

SEQ ID NO: 5135 - DNA, 19 bp, Artificial Sequence
  Synthetic Polynucleotide
aaactttctcaggagacct

SEQ ID NO: 5136 - DNA, 20 bp, Artificial Sequence
  Synthetic Polynucleotide
tccccgccatattttatgaa

SEQ ID NO: 5137 - DNA, 19 bp, Artificial Sequence
  Synthetic Polynucleotide
agcattaacgaactcaggc

SEQ ID NO: 5138 - DNA, 18 bp, Artificial Sequence
  Synthetic Polynucleotide
tctcagtagatcatccca

SEQ ID NO: 5139 - DNA, 17 bp, Artificial Sequence
  Synthetic Polynucleotide
ttttgaaagtgagcggg

SEQ ID NO: 5140 - DNA, 18 bp, Artificial Sequence
  Synthetic Polynucleotide
agtggcaaggagctgaaa

SEQ ID NO: 5141 - DNA, 18 bp, Artificial Sequence
  Synthetic Polynucleotide
ctcgaagaagcgatcctg

SEQ ID NO: 5142 - DNA, 17 bp, Artificial Sequence
  Synthetic Polynucleotide
actcgaaggtatgtcga

SEQ ID NO: 5143 - DNA, 18 bp, Artificial Sequence
  Synthetic Polynucleotide
taaccctacctttgaaga

SEQ ID NO: 5144 - DNA, 17 bp, Artificial Sequence
  Synthetic Polynucleotide
ggatcccactacaagga

SEQ ID NO: 5145 - DNA, 17 bp, Artificial Sequence
  Synthetic Polynucleotide
ctgggcattgtggcgag

SEQ ID NO: 5146 - DNA, 17 bp, Artificial Sequence
  Synthetic Polynucleotide
cgctgtaccaggcatcg

SEQ ID NO: 5147 - DNA, 19 bp, Artificial Sequence
  Synthetic Polynucleotide
ttcaaaacggaagtcatcg

SEQ ID NO: 5148 - DNA, 17 bp, Artificial Sequence
  Synthetic Polynucleotide
gcagttgaggagtacca

SEQ ID NO: 5149 - DNA, 20 bp, Artificial Sequence
  Synthetic Polynucleotide
gcagaagcgtgattggaaga

SEQ ID NO: 5150 - DNA, 19 bp, Artificial Sequence
  Synthetic Polynucleotide
atctgtggactgaacatga

SEQ ID NO: 5151 - DNA, 20 bp, Artificial Sequence
  Synthetic Polynucleotide
ttatggtgaacactcgaaag

SEQ ID NO: 5152 - DNA, 18 bp, Artificial Sequence
  Synthetic Polynucleotide
acataagtcgtcgggtac

SEQ ID NO: 5153 - DNA, 20 bp, Artificial Sequence
  Synthetic Polynucleotide
gagtctgcgaaagaatgcga

SEQ ID NO: 5154 - DNA, 20 bp, Artificial Sequence
  Synthetic Polynucleotide
ggcgaaatcaatagtttata

SEQ ID NO: 5155 - DNA, 17 bp, Artificial Sequence
  Synthetic Polynucleotide
ctacgtcaagtatgggc

SEQ ID NO: 5156 - DNA, 18 bp, Artificial Sequence
  Synthetic Polynucleotide
ccaggaggaggagatgga

SEQ ID NO: 5157 - DNA, 17 bp, Artificial Sequence
  Synthetic Polynucleotide
ccaaggtcagtgtgctc

SEQ ID NO: 5158 - DNA, 17 bp, Artificial Sequence
  Synthetic Polynucleotide
gtcagatatgggcgggg

SEQ ID NO: 5159 - DNA, 19 bp, Artificial Sequence
  Synthetic Polynucleotide
tcagaagggctagatcccg

SEQ ID NO: 5160 - DNA, 18 bp, Artificial Sequence
  Synthetic Polynucleotide
agaggaagagattgcagc

SEQ ID NO: 5161 - DNA, 17 bp, Artificial Sequence
  Synthetic Polynucleotide
accagaaggaggcgtgt

SEQ ID NO: 5162 - DNA, 17 bp, Artificial Sequence
  Synthetic Polynucleotide
ttgaggctttgggcgta

SEQ ID NO: 5163 - DNA, 17 bp, Artificial Sequence
  Synthetic Polynucleotide
ttccgtccacttcaatc

SEQ ID NO: 5164 - DNA, 19 bp, Artificial Sequence
  Synthetic Polynucleotide
ataggagtgtgcgtggatt

SEQ ID NO: 5165 - DNA, 19 bp, Artificial Sequence
  Synthetic Polynucleotide
tgtgggttttccatcgtaa

SEQ ID NO: 5166 - DNA, 17 bp, Artificial Sequence
  Synthetic Polynucleotide
cgaagagaaccgtgttt

SEQ ID NO: 5167 - DNA, 20 bp, Artificial Sequence
  Synthetic Polynucleotide
aagttgatacgtcaggtaga

SEQ ID NO: 5168 - DNA, 19 bp, Artificial Sequence
  Synthetic Polynucleotide
aatggtgtcgataagaaac

SEQ ID NO: 5169 - DNA, 17 bp, Artificial Sequence
  Synthetic Polynucleotide
gtcgaaagtaccgccac

SEQ ID NO: 5170 - DNA, 17 bp, Artificial Sequence
  Synthetic Polynucleotide
aaaagatgggttggtgt

SEQ ID NO: 5171 - DNA, 20 bp, Artificial Sequence
  Synthetic Polynucleotide
aaatactaggttttccaagg

SEQ ID NO: 5172 - DNA, 19 bp, Artificial Sequence
  Synthetic Polynucleotide
agagattcggagtgtgtat

SEQ ID NO: 5173 - DNA, 19 bp, Artificial Sequence
  Synthetic Polynucleotide
catctatcaatgtccccaa

SEQ ID NO: 5174 - DNA, 20 bp, Artificial Sequence
  Synthetic Polynucleotide
agaatgaaaagactggtgtt

SEQ ID NO: 5175 - DNA, 17 bp, Artificial Sequence
  Synthetic Polynucleotide
actagacctcgggtaaa

SEQ ID NO: 5176 - DNA, 17 bp, Artificial Sequence
  Synthetic Polynucleotide
ggtgcgaagatggtaag

SEQ ID NO: 5177 - DNA, 20 bp, Artificial Sequence
  Synthetic Polynucleotide
ttagcgtaagttgacaagta

SEQ ID NO: 5178 - DNA, 17 bp, Artificial Sequence
  Synthetic Polynucleotide
gaaaagagtgactgtgc

SEQ ID NO: 5179 - DNA, 19 bp, Artificial Sequence
  Synthetic Polynucleotide
tttcatctcccctttgatc

SEQ ID NO: 5180 - DNA, 20 bp, Artificial Sequence
  Synthetic Polynucleotide
tcaagaaaatggagtgttac

SEQ ID NO: 5181 - DNA, 17 bp, Artificial Sequence
  Synthetic Polynucleotide
tccagcgtcaataaagt

SEQ ID NO: 5182 - DNA, 20 bp, Artificial Sequence
  Synthetic Polynucleotide
aatattcccttgtgccgttt

SEQ ID NO: 5183 - DNA, 17 bp, Artificial Sequence
  Synthetic Polynucleotide
cccctagcgtaataggc

SEQ ID NO: 5184 - DNA, 20 bp, Artificial Sequence
  Synthetic Polynucleotide
tggaagattcaattaaggtc

SEQ ID NO: 5185 - DNA, 18 bp, Artificial Sequence
  Synthetic Polynucleotide
tccttcagaactttccaa

SEQ ID NO: 5186 - DNA, 17 bp, Artificial Sequence
  Synthetic Polynucleotide
cgtagcttttgcttggc

SEQ ID NO: 5187 - DNA, 19 bp, Artificial Sequence
  Synthetic Polynucleotide
tccaaacttagatgtgatg

SEQ ID NO: 5188 - DNA, 18 bp, Artificial Sequence
  Synthetic Polynucleotide
tagaccgctcaatgttga

SEQ ID NO: 5189 - DNA, 18 bp, Artificial Sequence
  Synthetic Polynucleotide
aaggtattcgtaagcctt

SEQ ID NO: 5190 - DNA, 18 bp, Artificial Sequence
  Synthetic Polynucleotide
agcgaagaaactgtatgc

SEQ ID NO: 5191 - DNA, 19 bp, Artificial Sequence
  Synthetic Polynucleotide
gcatcaatgtctctccctc

SEQ ID NO: 5192 - DNA, 19 bp, Artificial Sequence
  Synthetic Polynucleotide
tctagagagtacaacgtca

SEQ ID NO: 5193 - DNA, 17 bp, Artificial Sequence
  Synthetic Polynucleotide
atgatcctcccaccaag

SEQ ID NO: 5194 - DNA, 17 bp, Artificial Sequence
  Synthetic Polynucleotide
gaggtgctgctcaagtt

SEQ ID NO: 5195 - DNA, 18 bp, Artificial Sequence
  Synthetic Polynucleotide
gcatttgaccaccaagtt

SEQ ID NO: 5196 - DNA, 20 bp, Artificial Sequence
  Synthetic Polynucleotide
attctagctctcttcctgaa

SEQ ID NO: 5197 - DNA, 19 bp, Artificial Sequence
  Synthetic Polynucleotide
aacagaaataagggaccga

SEQ ID NO: 5198 - DNA, 19 bp, Artificial Sequence
  Synthetic Polynucleotide
ttgtcttatactcgggcat

SEQ ID NO: 5199 - DNA, 18 bp, Artificial Sequence
  Synthetic Polynucleotide
cttgctgatgagacctgc

SEQ ID NO: 5200 - DNA, 19 bp, Artificial Sequence
  Synthetic Polynucleotide
ttacacgtcaaagaagttt

SEQ ID NO: 5201 - DNA, 20 bp, Artificial Sequence
  Synthetic Polynucleotide
tttatctcaccgattttctc

SEQ ID NO: 5202 - DNA, 20 bp, Artificial Sequence
  Synthetic Polynucleotide
atggatatctcaatgtttgg

SEQ ID NO: 5203 - DNA, 18 bp, Artificial Sequence
  Synthetic Polynucleotide
accttgcttaaaggggtc

SEQ ID NO: 5204 - DNA, 20 bp, Artificial Sequence
  Synthetic Polynucleotide
tcgagaggttgttaaactct

SEQ ID NO: 5205 - DNA, 20 bp, Artificial Sequence
  Synthetic Polynucleotide
gagccaacaaaatccgtctt

SEQ ID NO: 5206 - DNA, 20 bp, Artificial Sequence
  Synthetic Polynucleotide
tatttaccaaagggattttc

SEQ ID NO: 5207 - DNA, 19 bp, Artificial Sequence
  Synthetic Polynucleotide
caaaatgtgtcgaaggttg

SEQ ID NO: 5208 - DNA, 19 bp, Artificial Sequence
  Synthetic Polynucleotide
agagatgtgctgatgttca

SEQ ID NO: 5209 - DNA, 19 bp, Artificial Sequence
  Synthetic Polynucleotide
atagtccaagactttaccg

SEQ ID NO: 5210 - DNA, 19 bp, Artificial Sequence
  Synthetic Polynucleotide
tggcatcttacagaaactc

SEQ ID NO: 5211 - DNA, 18 bp, Artificial Sequence
  Synthetic Polynucleotide
tttgtgtccaacatagca

SEQ ID NO: 5212 - DNA, 20 bp, Artificial Sequence
  Synthetic Polynucleotide
ctccctggtgatctggagta

SEQ ID NO: 5213 - DNA, 19 bp, Artificial Sequence
  Synthetic Polynucleotide
gcgctttaaatcacactcc

SEQ ID NO: 5214 - DNA, 19 bp, Artificial Sequence
  Synthetic Polynucleotide
aaacaaacagctttcgttc

SEQ ID NO: 5215 - DNA, 18 bp, Artificial Sequence
  Synthetic Polynucleotide
aaaggcacaacctcaaag

SEQ ID NO: 5216 - DNA, 20 bp, Artificial Sequence
  Synthetic Polynucleotide
agaacagtatgacgagtttt

SEQ ID NO: 5217 - DNA, 19 bp, Artificial Sequence
  Synthetic Polynucleotide
cacccacataggatttatc

SEQ ID NO: 5218 - DNA, 18 bp, Artificial Sequence
  Synthetic Polynucleotide
gctcattacgttcaagtg

SEQ ID NO: 5219 - DNA, 18 bp, Artificial Sequence
  Synthetic Polynucleotide
gccaacactaatggctgc

SEQ ID NO: 5220 - DNA, 17 bp, Artificial Sequence
  Synthetic Polynucleotide
ctccttccgccaaactg

SEQ ID NO: 5221 - DNA, 19 bp, Artificial Sequence
  Synthetic Polynucleotide
gttgtcttaggtagtccta

SEQ ID NO: 5222 - DNA, 18 bp, Artificial Sequence
  Synthetic Polynucleotide
caaggttcacatgactgt

SEQ ID NO: 5223 - DNA, 19 bp, Artificial Sequence
  Synthetic Polynucleotide
accaaacaaaacaaaccaa

SEQ ID NO: 5224 - DNA, 17 bp, Artificial Sequence
  Synthetic Polynucleotide
ttggtgtcgagataacc

SEQ ID NO: 5225 - DNA, 20 bp, Artificial Sequence
  Synthetic Polynucleotide
aaacataaaaggccccaaac

SEQ ID NO: 5226 - DNA, 18 bp, Artificial Sequence
  Synthetic Polynucleotide
aagaatgtctgtctgtca

SEQ ID NO: 5227 - DNA, 18 bp, Artificial Sequence
  Synthetic Polynucleotide
caaacccatgttatcgcc

SEQ ID NO: 5228 - DNA, 20 bp, Artificial Sequence
  Synthetic Polynucleotide
gaagagaatatccatcccgc

SEQ ID NO: 5229 - DNA, 18 bp, Artificial Sequence
  Synthetic Polynucleotide
gaagaaccgagaaagaga

SEQ ID NO: 5230 - DNA, 20 bp, Artificial Sequence
  Synthetic Polynucleotide
atacggctttcaaagtgaaa

SEQ ID NO: 5231 - DNA, 18 bp, Artificial Sequence
  Synthetic Polynucleotide
aactggaactgcatcatg

SEQ ID NO: 5232 - DNA, 20 bp, Artificial Sequence
  Synthetic Polynucleotide
ctccaatgacaatctggata

SEQ ID NO: 5233 - DNA, 17 bp, Artificial Sequence
  Synthetic Polynucleotide
aaaggctcatcagcttt

SEQ ID NO: 5234 - DNA, 18 bp, Artificial Sequence
  Synthetic Polynucleotide
tttgataaccgcaaacgt

SEQ ID NO: 5235 - DNA, 17 bp, Artificial Sequence
  Synthetic Polynucleotide
cctgctaaacaggagct

SEQ ID NO: 5236 - DNA, 18 bp, Artificial Sequence
  Synthetic Polynucleotide
gttttctcccaacaagag

SEQ ID NO: 5237 - DNA, 17 bp, Artificial Sequence
  Synthetic Polynucleotide
cacactgtcgccactaa

SEQ ID NO: 5238 - DNA, 18 bp, Artificial Sequence
  Synthetic Polynucleotide
cacctacccacatcattt

SEQ ID NO: 5239 - DNA, 17 bp, Artificial Sequence
  Synthetic Polynucleotide
gtgtccaaatgccactc

SEQ ID NO: 5240 - DNA, 18 bp, Artificial Sequence
  Synthetic Polynucleotide
tacatacgctggcattaa

SEQ ID NO: 5241 - DNA, 18 bp, Artificial Sequence
  Synthetic Polynucleotide
acacactgtcgccactaa

SEQ ID NO: 5242 - DNA, 19 bp, Artificial Sequence
  Synthetic Polynucleotide
aaatgttgcaggcgttgtg

SEQ ID NO: 5243 - DNA, 19 bp, Artificial Sequence
  Synthetic Polynucleotide
aagccttcccacacacata

SEQ ID NO: 5244 - DNA, 18 bp, Artificial Sequence
  Synthetic Polynucleotide
aacaaacagctttcgttc

SEQ ID NO: 5245 - DNA, 18 bp, Artificial Sequence
  Synthetic Polynucleotide
catcacgttgaatggcag

SEQ ID NO: 5246 - DNA, 17 bp, Artificial Sequence
  Synthetic Polynucleotide
ggatcccatgtaccaga

SEQ ID NO: 5247 - DNA, 19 bp, Artificial Sequence
  Synthetic Polynucleotide
tgagcaccacctcatttcc

SEQ ID NO: 5248 - DNA, 19 bp, Artificial Sequence
  Synthetic Polynucleotide
taccacattgtagattggg

SEQ ID NO: 5249 - DNA, 20 bp, Artificial Sequence
  Synthetic Polynucleotide
gccgatatccactccaatat

SEQ ID NO: 5250 - DNA, 18 bp, Artificial Sequence
  Synthetic Polynucleotide
agcgttgatgcgattttg

SEQ ID NO: 5251 - DNA, 20 bp, Artificial Sequence
  Synthetic Polynucleotide
tgcactagccttcttgaaaa

SEQ ID NO: 5252 - DNA, 18 bp, Artificial Sequence
  Synthetic Polynucleotide
tcagcacccttcatagct

SEQ ID NO: 5253 - DNA, 18 bp, Artificial Sequence
  Synthetic Polynucleotide
caaagtcaagtcgatcac

SEQ ID NO: 5254 - DNA, 20 bp, Artificial Sequence
  Synthetic Polynucleotide
ttctgactttgatgagaact

SEQ ID NO: 5255 - DNA, 18 bp, Artificial Sequence
  Synthetic Polynucleotide
attctaaactagcccgtt

SEQ ID NO: 5256 - DNA, 18 bp, Artificial Sequence
  Synthetic Polynucleotide
gccttacataccaggccg

SEQ ID NO: 5257 - DNA, 17 bp, Artificial Sequence
  Synthetic Polynucleotide
agtccccacttatcgtg

SEQ ID NO: 5258 - DNA, 18 bp, Artificial Sequence
  Synthetic Polynucleotide
cactttgcaggaaaagca

SEQ ID NO: 5259 - DNA, 17 bp, Artificial Sequence
  Synthetic Polynucleotide
cccactgctgaacatca

SEQ ID NO: 5260 - DNA, 17 bp, Artificial Sequence
  Synthetic Polynucleotide
acgcagactgttgattc

SEQ ID NO: 5261 - DNA, 19 bp, Artificial Sequence
  Synthetic Polynucleotide
ccatcatcactcaaaatca

SEQ ID NO: 5262 - DNA, 19 bp, Artificial Sequence
  Synthetic Polynucleotide
gtgatcgtgctatgccaaa

SEQ ID NO: 5263 - DNA, 20 bp, Artificial Sequence
  Synthetic Polynucleotide
tgtgaacaaaattcatgtgg

SEQ ID NO: 5264 - DNA, 19 bp, Artificial Sequence
  Synthetic Polynucleotide
taaaaccaggtcactttaa

SEQ ID NO: 5265 - DNA, 20 bp, Artificial Sequence
  Synthetic Polynucleotide
acatggtcataacaacactt

SEQ ID NO: 5266 - DNA, 17 bp, Artificial Sequence
  Synthetic Polynucleotide
ctgacggtacgctcatg

SEQ ID NO: 5267 - DNA, 20 bp, Artificial Sequence
  Synthetic Polynucleotide
ttgcaaatcctctataaagc

SEQ ID NO: 5268 - DNA, 20 bp, Artificial Sequence
  Synthetic Polynucleotide
tgtgcattcgctatgtttag

SEQ ID NO: 5269 - DNA, 20 bp, Artificial Sequence
  Synthetic Polynucleotide
gagtcgagtttcaatgtttg

SEQ ID NO: 5270 - DNA, 20 bp, Artificial Sequence
  Synthetic Polynucleotide
acacacgtccaactcagttt

SEQ ID NO: 5271 - DNA, 20 bp, Artificial Sequence
  Synthetic Polynucleotide
cccaacgctaggctcaaaag

SEQ ID NO: 5272 - DNA, 19 bp, Artificial Sequence
  Synthetic Polynucleotide
gttgcttgggctacctagt

SEQ ID NO: 5273 - DNA, 19 bp, Artificial Sequence
  Synthetic Polynucleotide
caccatcatcactcaaaat

SEQ ID NO: 5274 - DNA, 20 bp, Artificial Sequence
  Synthetic Polynucleotide
tgctattagtgctaagaata

SEQ ID NO: 5275 - DNA, 17 bp, Artificial Sequence
  Synthetic Polynucleotide
gaaccaacataacccca

SEQ ID NO: 5276 - DNA, 17 bp, Artificial Sequence
  Synthetic Polynucleotide
acaatacagggtcctcc

SEQ ID NO: 5277 - DNA, 19 bp, Artificial Sequence
  Synthetic Polynucleotide
gcggatctttaattactcg

SEQ ID NO: 5278 - DNA, 18 bp, Artificial Sequence
  Synthetic Polynucleotide
tatgctcagatcgccagt

SEQ ID NO: 5279 - DNA, 20 bp, Artificial Sequence
  Synthetic Polynucleotide
agcggatctttaaacttctc

SEQ ID NO: 5280 - DNA, 17 bp, Artificial Sequence
  Synthetic Polynucleotide
tgacacacaggttgaga

SEQ ID NO: 5281 - DNA, 20 bp, Artificial Sequence
  Synthetic Polynucleotide
aactatccaaaccaccattt

SEQ ID NO: 5282 - DNA, 17 bp, Artificial Sequence
  Synthetic Polynucleotide
taccactttccacttta

SEQ ID NO: 5283 - DNA, 18 bp, Artificial Sequence
  Synthetic Polynucleotide
gtcacaacattacttgca

SEQ ID NO: 5284 - DNA, 20 bp, Artificial Sequence
  Synthetic Polynucleotide
tatagagggtatcatagcgc

SEQ ID NO: 5285 - DNA, 17 bp, Artificial Sequence
  Synthetic Polynucleotide
atggcgttcaccatgtt

SEQ ID NO: 5286 - DNA, 17 bp, Artificial Sequence
  Synthetic Polynucleotide
tggctcggcaaggatgg

SEQ ID NO: 5287 - DNA, 18 bp, Artificial Sequence
  Synthetic Polynucleotide
tcttggacggagttgcgt

SEQ ID NO: 5288 - DNA, 18 bp, Artificial Sequence
  Synthetic Polynucleotide
gcggatcattgaactgga

SEQ ID NO: 5289 - DNA, 18 bp, Artificial Sequence
  Synthetic Polynucleotide
ctcatctgcttgttcatc

SEQ ID NO: 5290 - DNA, 20 bp, Artificial Sequence
  Synthetic Polynucleotide
agaagagaagaagaagctcg

SEQ ID NO: 5291 - DNA, 17 bp, Artificial Sequence
  Synthetic Polynucleotide
aacatagtcacctcacg

SEQ ID NO: 5292 - DNA, 20 bp, Artificial Sequence
  Synthetic Polynucleotide
tgtggcattctgcaaaccag

SEQ ID NO: 5293 - DNA, 17 bp, Artificial Sequence
  Synthetic Polynucleotide
cgtcttgatgacgacag

SEQ ID NO: 5294 - DNA, 17 bp, Artificial Sequence
  Synthetic Polynucleotide
gcttacacctttcacca

SEQ ID NO: 5295 - DNA, 18 bp, Artificial Sequence
  Synthetic Polynucleotide
cattcatctgcgggtttt

SEQ ID NO: 5296 - DNA, 17 bp, Artificial Sequence
  Synthetic Polynucleotide
ggcggtcataagggcaa

SEQ ID NO: 5297 - DNA, 17 bp, Artificial Sequence
  Synthetic Polynucleotide
tacctatggctaggagt

SEQ ID NO: 5298 - DNA, 17 bp, Artificial Sequence
  Synthetic Polynucleotide
actccctcaccaccctg

SEQ ID NO: 5299 - DNA, 18 bp, Artificial Sequence
  Synthetic Polynucleotide
atgacgacgaatacgatc

SEQ ID NO: 5300 - DNA, 20 bp, Artificial Sequence
  Synthetic Polynucleotide
atcacctaagcgtaaacgac

SEQ ID NO: 5301 - DNA, 18 bp, Artificial Sequence
  Synthetic Polynucleotide
gtagcgttgcattgaagc

SEQ ID NO: 5302 - DNA, 17 bp, Artificial Sequence
  Synthetic Polynucleotide
cattgatggatacggct

SEQ ID NO: 5303 - DNA, 17 bp, Artificial Sequence
  Synthetic Polynucleotide
aggtatgtcaaaacggc

SEQ ID NO: 5304 - DNA, 19 bp, Artificial Sequence
  Synthetic Polynucleotide
gctgtacacactcagacta

SEQ ID NO: 5305 - DNA, 17 bp, Artificial Sequence
  Synthetic Polynucleotide
cacctgattggacaact

SEQ ID NO: 5306 - DNA, 20 bp, Artificial Sequence
  Synthetic Polynucleotide
tgtcaaagagagttgggctt

SEQ ID NO: 5307 - DNA, 19 bp, Artificial Sequence
  Synthetic Polynucleotide
tatttggagtttccacatc

SEQ ID NO: 5308 - DNA, 18 bp, Artificial Sequence
  Synthetic Polynucleotide
ctatttagggtgaggagc

SEQ ID NO: 5309 - DNA, 20 bp, Artificial Sequence
  Synthetic Polynucleotide
gaacatgaatctgatgcctt

SEQ ID NO: 5310 - DNA, 17 bp, Artificial Sequence
  Synthetic Polynucleotide
gagttgcatgttgacac

SEQ ID NO: 5311 - DNA, 19 bp, Artificial Sequence
  Synthetic Polynucleotide
agttgggtgctgaactgaa

SEQ ID NO: 5312 - DNA, 18 bp, Artificial Sequence
  Synthetic Polynucleotide
acgaccttggatgtactg

SEQ ID NO: 5313 - DNA, 19 bp, Artificial Sequence
  Synthetic Polynucleotide
cttagaaagaggttgcgaa

SEQ ID NO: 5314 - DNA, 18 bp, Artificial Sequence
  Synthetic Polynucleotide
ggaagtgtgtatgaagcc

SEQ ID NO: 5315 - DNA, 17 bp, Artificial Sequence
  Synthetic Polynucleotide
aatggttgagcgttgac

SEQ ID NO: 5316 - DNA, 19 bp, Artificial Sequence
  Synthetic Polynucleotide
cgctatgcgaaatagagtt

SEQ ID NO: 5317 - DNA, 17 bp, Artificial Sequence
  Synthetic Polynucleotide
tctagttgggttgagtg

SEQ ID NO: 5318 - DNA, 18 bp, Artificial Sequence
  Synthetic Polynucleotide
attgttcttcaatggtgc

SEQ ID NO: 5319 - DNA, 19 bp, Artificial Sequence
  Synthetic Polynucleotide
gaaaccttgggtgtaaatt

SEQ ID NO: 5320 - DNA, 17 bp, Artificial Sequence
  Synthetic Polynucleotide
ggttccactcgtagaga

SEQ ID NO: 5321 - DNA, 19 bp, Artificial Sequence
  Synthetic Polynucleotide
gccccgccagtatttgaaa

SEQ ID NO: 5322 - DNA, 18 bp, Artificial Sequence
  Synthetic Polynucleotide
agattggggcttgttcga

SEQ ID NO: 5323 - DNA, 18 bp, Artificial Sequence
  Synthetic Polynucleotide
accaggtattttggtgag

SEQ ID NO: 5324 - DNA, 20 bp, Artificial Sequence
  Synthetic Polynucleotide
taatgttgttacgaatccta

SEQ ID NO: 5325 - DNA, 19 bp, Artificial Sequence
  Synthetic Polynucleotide
caagtgaggaggtgataag

SEQ ID NO: 5326 - DNA, 17 bp, Artificial Sequence
  Synthetic Polynucleotide
gacgattttgattgcgg

SEQ ID NO: 5327 - DNA, 17 bp, Artificial Sequence
  Synthetic Polynucleotide
ttgcctatggtcatcaa

SEQ ID NO: 5328 - DNA, 20 bp, Artificial Sequence
  Synthetic Polynucleotide
tgagcaggagttttgggaca

SEQ ID NO: 5329 - DNA, 19 bp, Artificial Sequence
  Synthetic Polynucleotide
tggtctagctgttacaaaa

SEQ ID NO: 5330 - DNA, 19 bp, Artificial Sequence
  Synthetic Polynucleotide
ccatgggaaagtgataaaa

SEQ ID NO: 5331 - DNA, 18 bp, Artificial Sequence
  Synthetic Polynucleotide
gtttctggctgaggacgg

SEQ ID NO: 5332 - DNA, 19 bp, Artificial Sequence
  Synthetic Polynucleotide
tagatgcaataaactcagg

SEQ ID NO: 5333 - DNA, 17 bp, Artificial Sequence
  Synthetic Polynucleotide
gcccaataaaccttcca

SEQ ID NO: 5334 - DNA, 18 bp, Artificial Sequence
  Synthetic Polynucleotide
ggcaacaatgggaccgac

SEQ ID NO: 5335 - DNA, 20 bp, Artificial Sequence
  Synthetic Polynucleotide
gtgttgagcaccaaaatttt

SEQ ID NO: 5336 - DNA, 17 bp, Artificial Sequence
  Synthetic Polynucleotide
ctgcaacatggacagat

SEQ ID NO: 5337 - DNA, 17 bp, Artificial Sequence
  Synthetic Polynucleotide
agcaggatctctggtct

SEQ ID NO: 5338 - DNA, 18 bp, Artificial Sequence
  Synthetic Polynucleotide
ggttagaggagacccctc

SEQ ID NO: 5339 - DNA, 18 bp, Artificial Sequence
  Synthetic Polynucleotide
tatcaggcagtaccacaa

SEQ ID NO: 5340 - DNA, 17 bp, Artificial Sequence
  Synthetic Polynucleotide
gagagccatagtggtct

SEQ ID NO: 5341 - DNA, 18 bp, Artificial Sequence
  Synthetic Polynucleotide
aggtgtcaatatgctgtt

SEQ ID NO: 5342 - DNA, 18 bp, Artificial Sequence
  Synthetic Polynucleotide
actagaggttagaggaga

SEQ ID NO: 5343 - DNA, 17 bp, Artificial Sequence
  Synthetic Polynucleotide
caactccatgtgccatg

SEQ ID NO: 5344 - DNA, 17 bp, Artificial Sequence
  Synthetic Polynucleotide
ctgagtacaggacagtc

SEQ ID NO: 5345 - DNA, 18 bp, Artificial Sequence
  Synthetic Polynucleotide
tctctttcccatcatgtt

SEQ ID NO: 5346 - DNA, 17 bp, Artificial Sequence
  Synthetic Polynucleotide
ctcctttgtgacatcgg

SEQ ID NO: 5347 - DNA, 19 bp, Artificial Sequence
  Synthetic Polynucleotide
aactccatgtgccatgtac

SEQ ID NO: 5348 - DNA, 17 bp, Artificial Sequence
  Synthetic Polynucleotide
atgcccttagtaggact

SEQ ID NO: 5349 - DNA, 20 bp, Artificial Sequence
  Synthetic Polynucleotide
ggacagttgtattccattga

SEQ ID NO: 5350 - DNA, 20 bp, Artificial Sequence
  Synthetic Polynucleotide
ttgctaggcaataaacacat

SEQ ID NO: 5351 - DNA, 17 bp, Artificial Sequence
  Synthetic Polynucleotide
gcccattcgctcgacaa

SEQ ID NO: 5352 - DNA, 18 bp, Artificial Sequence
  Synthetic Polynucleotide
tcgtcgttaaaccgagcc

SEQ ID NO: 5353 - DNA, 19 bp, Artificial Sequence
  Synthetic Polynucleotide
cattccattttctggcgtt

SEQ ID NO: 5354 - DNA, 17 bp, Artificial Sequence
  Synthetic Polynucleotide
tgtgagccccgtccaag

SEQ ID NO: 5355 - DNA, 17 bp, Artificial Sequence
  Synthetic Polynucleotide
cacacaggtgccattct

SEQ ID NO: 5356 - DNA, 20 bp, Artificial Sequence
  Synthetic Polynucleotide
gcttaggagaacaagagctg

SEQ ID NO: 5357 - DNA, 17 bp, Artificial Sequence
  Synthetic Polynucleotide
ctatcaggcagtaccac

SEQ ID NO: 5358 - DNA, 19 bp, Artificial Sequence
  Synthetic Polynucleotide
ggcgttagtatgagtgtcg

SEQ ID NO: 5359 - DNA, 18 bp, Artificial Sequence
  Synthetic Polynucleotide
acccatcaccttcatcca

SEQ ID NO: 5360 - DNA, 18 bp, Artificial Sequence
  Synthetic Polynucleotide
cggcgtctatactacctc

SEQ ID NO: 5361 - DNA, 20 bp, Artificial Sequence
  Synthetic Polynucleotide
atccatccataacattgaac

SEQ ID NO: 5362 - DNA, 18 bp, Artificial Sequence
  Synthetic Polynucleotide
tttcaaggatctgaaccc

SEQ ID NO: 5363 - DNA, 19 bp, Artificial Sequence
  Synthetic Polynucleotide
tttcccatcatgttgtaca

SEQ ID NO: 5364 - DNA, 17 bp, Artificial Sequence
  Synthetic Polynucleotide
aaagtgcggagccatgc

SEQ ID NO: 5365 - DNA, 18 bp, Artificial Sequence
  Synthetic Polynucleotide
aacttatccccattgtga

SEQ ID NO: 5366 - DNA, 17 bp, Artificial Sequence
  Synthetic Polynucleotide
gacatccgagagtttgt

SEQ ID NO: 5367 - DNA, 17 bp, Artificial Sequence
  Synthetic Polynucleotide
agggagaacaagaaccg

SEQ ID NO: 5368 - DNA, 17 bp, Artificial Sequence
  Synthetic Polynucleotide
ggccatctggtacatgt

SEQ ID NO: 5369 - DNA, 17 bp, Artificial Sequence
  Synthetic Polynucleotide
ttccccatcatgttgta

SEQ ID NO: 5370 - DNA, 17 bp, Artificial Sequence
  Synthetic Polynucleotide
ggacagcagagagtgtt

SEQ ID NO: 5371 - DNA, 18 bp, Artificial Sequence
  Synthetic Polynucleotide
ttctgtagtctttcctgc

SEQ ID NO: 5372 - DNA, 20 bp, Artificial Sequence
  Synthetic Polynucleotide
tatgagatagatgaatccca

SEQ ID NO: 5373 - DNA, 20 bp, Artificial Sequence
  Synthetic Polynucleotide
tcagcatagccctcttcagt

SEQ ID NO: 5374 - DNA, 20 bp, Artificial Sequence
  Synthetic Polynucleotide
aaacttagtagtgtttgtga

SEQ ID NO: 5375 - DNA, 18 bp, Artificial Sequence
  Synthetic Polynucleotide
acaccaacagtcaatgtc

SEQ ID NO: 5376 - DNA, 19 bp, Artificial Sequence
  Synthetic Polynucleotide
gttcttcagatttacagca

SEQ ID NO: 5377 - DNA, 17 bp, Artificial Sequence
  Synthetic Polynucleotide
gcctcagccaacttcat

SEQ ID NO: 5378 - DNA, 19 bp, Artificial Sequence
  Synthetic Polynucleotide
cgggttgacaatgccagtg

SEQ ID NO: 5379 - DNA, 18 bp, Artificial Sequence
  Synthetic Polynucleotide
ctctccatccacatccaa

SEQ ID NO: 5380 - DNA, 18 bp, Artificial Sequence
  Synthetic Polynucleotide
aggatcggagtcaatgga

SEQ ID NO: 5381 - DNA, 20 bp, Artificial Sequence
  Synthetic Polynucleotide
ctttcctaatgtcctctatg

SEQ ID NO: 5382 - DNA, 18 bp, Artificial Sequence
  Synthetic Polynucleotide
ggagtgttccataccatg

SEQ ID NO: 5383 - DNA, 17 bp, Artificial Sequence
  Synthetic Polynucleotide
gtctttcccgtcagctc

SEQ ID NO: 5384 - DNA, 17 bp, Artificial Sequence
  Synthetic Polynucleotide
tgcggaagatcgaaact

SEQ ID NO: 5385 - DNA, 18 bp, Artificial Sequence
  Synthetic Polynucleotide
aatgtcctttctcacctt

SEQ ID NO: 5386 - DNA, 17 bp, Artificial Sequence
  Synthetic Polynucleotide
cgaacatcaaggtgcag

SEQ ID NO: 5387 - DNA, 17 bp, Artificial Sequence
  Synthetic Polynucleotide
tgtgcttcatccatgat

SEQ ID NO: 5388 - DNA, 19 bp, Artificial Sequence
  Synthetic Polynucleotide
ggctcctactagggtagtc

SEQ ID NO: 5389 - DNA, 20 bp, Artificial Sequence
  Synthetic Polynucleotide
cggtgtcagtagtgtaagcc

SEQ ID NO: 5390 - DNA, 18 bp, Artificial Sequence
  Synthetic Polynucleotide
gtgctactcgtcatgttt

SEQ ID NO: 5391 - DNA, 20 bp, Artificial Sequence
  Synthetic Polynucleotide
gaatgtccgttgccacaatt

SEQ ID NO: 5392 - DNA, 18 bp, Artificial Sequence
  Synthetic Polynucleotide
cacagttgaaaccatctt

SEQ ID NO: 5393 - DNA, 18 bp, Artificial Sequence
  Synthetic Polynucleotide
cagcctcattattagcgg

SEQ ID NO: 5394 - DNA, 18 bp, Artificial Sequence
  Synthetic Polynucleotide
atgtcgtgttgttgctag

SEQ ID NO: 5395 - DNA, 18 bp, Artificial Sequence
  Synthetic Polynucleotide
tctggtcctctatagtgt

SEQ ID NO: 5396 - DNA, 18 bp, Artificial Sequence
  Synthetic Polynucleotide
cttccaaaagcagtgata

SEQ ID NO: 5397 - DNA, 18 bp, Artificial Sequence
  Synthetic Polynucleotide
gtggctcaatggagtaac

SEQ ID NO: 5398 - DNA, 19 bp, Artificial Sequence
  Synthetic Polynucleotide
tgaatacctggaaatcgaa

SEQ ID NO: 5399 - DNA, 17 bp, Artificial Sequence
  Synthetic Polynucleotide
cgtggtgagattcactg

SEQ ID NO: 5400 - DNA, 20 bp, Artificial Sequence
  Synthetic Polynucleotide
gcgccagttttcactaagtg

SEQ ID NO: 5401 - DNA, 18 bp, Artificial Sequence
  Synthetic Polynucleotide
tgacattcgtctgttcca

SEQ ID NO: 5402 - DNA, 17 bp, Artificial Sequence
  Synthetic Polynucleotide
cattccacctgcttggg

SEQ ID NO: 5403 - DNA, 18 bp, Artificial Sequence
  Synthetic Polynucleotide
ccgcctcagtcactgtct

SEQ ID NO: 5404 - DNA, 17 bp, Artificial Sequence
  Synthetic Polynucleotide
ctcaatccctcagtggc

SEQ ID NO: 5405 - DNA, 17 bp, Artificial Sequence
  Synthetic Polynucleotide
aaacttaacccgttcca

SEQ ID NO: 5406 - DNA, 20 bp, Artificial Sequence
  Synthetic Polynucleotide
atgaagcattcataccaaat

SEQ ID NO: 5407 - DNA, 19 bp, Artificial Sequence
  Synthetic Polynucleotide
ttcatacaatcaaaccaga

SEQ ID NO: 5408 - DNA, 17 bp, Artificial Sequence
  Synthetic Polynucleotide
actgctgcctttgtgaa

SEQ ID NO: 5409 - DNA, 17 bp, Artificial Sequence
  Synthetic Polynucleotide
gcaccacacttacacac

SEQ ID NO: 5410 - DNA, 18 bp, Artificial Sequence
  Synthetic Polynucleotide
gtacatcgccttggtcgg

SEQ ID NO: 5411 - DNA, 19 bp, Artificial Sequence
  Synthetic Polynucleotide
gtatcacctcagttactcc

SEQ ID NO: 5412 - DNA, 17 bp, Artificial Sequence
  Synthetic Polynucleotide
atgccacttacaccgcc

SEQ ID NO: 5413 - DNA, 18 bp, Artificial Sequence
  Synthetic Polynucleotide
gtatcacctcggttactc

SEQ ID NO: 5414 - DNA, 20 bp, Artificial Sequence
  Synthetic Polynucleotide
tgtgagtacatctcattcca

SEQ ID NO: 5415 - DNA, 19 bp, Artificial Sequence
  Synthetic Polynucleotide
gctcgcaaaattcacctct

SEQ ID NO: 5416 - DNA, 19 bp, Artificial Sequence
  Synthetic Polynucleotide
tgatagtaatagacgcccc

SEQ ID NO: 5417 - DNA, 20 bp, Artificial Sequence
  Synthetic Polynucleotide
taggtcatacgcactcgatg

SEQ ID NO: 5418 - DNA, 17 bp, Artificial Sequence
  Synthetic Polynucleotide
ctcgctactcctatagc

SEQ ID NO: 5419 - DNA, 19 bp, Artificial Sequence
  Synthetic Polynucleotide
cgattccacatacccagag

SEQ ID NO: 5420 - DNA, 19 bp, Artificial Sequence
  Synthetic Polynucleotide
ggcctcaagtttctcccag

SEQ ID NO: 5421 - DNA, 17 bp, Artificial Sequence
  Synthetic Polynucleotide
tactacatcaatgccac

SEQ ID NO: 5422 - DNA, 18 bp, Artificial Sequence
  Synthetic Polynucleotide
ggaatatccccttctgcg

SEQ ID NO: 5423 - DNA, 18 bp, Artificial Sequence
  Synthetic Polynucleotide
ttcgcctacaaattaggt

SEQ ID NO: 5424 - DNA, 18 bp, Artificial Sequence
  Synthetic Polynucleotide
aggcaaatatcctccttc

SEQ ID NO: 5425 - DNA, 20 bp, Artificial Sequence
  Synthetic Polynucleotide
agcaccttcttgttcaatac

SEQ ID NO: 5426 - DNA, 18 bp, Artificial Sequence
  Synthetic Polynucleotide
tctgtccagttgtccttc

SEQ ID NO: 5427 - DNA, 20 bp, Artificial Sequence
  Synthetic Polynucleotide
tctacaagcctgacacagat

SEQ ID NO: 5428 - DNA, 17 bp, Artificial Sequence
  Synthetic Polynucleotide
acgtccagaaccctgta

SEQ ID NO: 5429 - DNA, 19 bp, Artificial Sequence
  Synthetic Polynucleotide
caacaacaaatacatgagc

SEQ ID NO: 5430 - DNA, 18 bp, Artificial Sequence
  Synthetic Polynucleotide
aaacttaaccccgttcca

SEQ ID NO: 5431 - DNA, 17 bp, Artificial Sequence
  Synthetic Polynucleotide
tacatcaaactcaacgc

SEQ ID NO: 5432 - DNA, 19 bp, Artificial Sequence
  Synthetic Polynucleotide
tccattttcttcacccact

SEQ ID NO: 5433 - DNA, 17 bp, Artificial Sequence
  Synthetic Polynucleotide
catcaatgccacacaca

SEQ ID NO: 5434 - DNA, 17 bp, Artificial Sequence
  Synthetic Polynucleotide
ccaccagactttcactg

SEQ ID NO: 5435 - DNA, 17 bp, Artificial Sequence
  Synthetic Polynucleotide
ctttcctcaactccgat

SEQ ID NO: 5436 - DNA, 17 bp, Artificial Sequence
  Synthetic Polynucleotide
tccagagccctgtaaac

SEQ ID NO: 5437 - DNA, 17 bp, Artificial Sequence
  Synthetic Polynucleotide
aactggtctcgaaaagg

SEQ ID NO: 5438 - DNA, 17 bp, Artificial Sequence
  Synthetic Polynucleotide
agctgttgtggtaacag

SEQ ID NO: 5439 - DNA, 18 bp, Artificial Sequence
  Synthetic Polynucleotide
cctcattcacatagctta

SEQ ID NO: 5440 - DNA, 17 bp, Artificial Sequence
  Synthetic Polynucleotide
gacctggaagaggcagt

SEQ ID NO: 5441 - DNA, 19 bp, Artificial Sequence
  Synthetic Polynucleotide
gtgtgcgtgaagttttctc

SEQ ID NO: 5442 - DNA, 18 bp, Artificial Sequence
  Synthetic Polynucleotide
ctcacctaatctgtaggc

SEQ ID NO: 5443 - DNA, 18 bp, Artificial Sequence
  Synthetic Polynucleotide
gcgtgtcaaaggagtttc

SEQ ID NO: 5444 - DNA, 18 bp, Artificial Sequence
  Synthetic Polynucleotide
ggaatatccccttctgcg

SEQ ID NO: 5445 - DNA, 18 bp, Artificial Sequence
  Synthetic Polynucleotide
gttccaatgttttgtgga

SEQ ID NO: 5446 - DNA, 17 bp, Artificial Sequence
  Synthetic Polynucleotide
gaacattctgtgttggc

SEQ ID NO: 5447 - DNA, 19 bp, Artificial Sequence
  Synthetic Polynucleotide
atcaacaagccaaagatga

SEQ ID NO: 5448 - DNA, 17 bp, Artificial Sequence
  Synthetic Polynucleotide
tagtcatcatgtcctcc

SEQ ID NO: 5449 - DNA, 17 bp, Artificial Sequence
  Synthetic Polynucleotide
gtgccctgatggaatct

SEQ ID NO: 5450 - DNA, 19 bp, Artificial Sequence
  Synthetic Polynucleotide
tgaaaagcatatttgccat

SEQ ID NO: 5451 - DNA, 19 bp, Artificial Sequence
  Synthetic Polynucleotide
tcattgagaagtcccctgg

SEQ ID NO: 5452 - DNA, 19 bp, Artificial Sequence
  Synthetic Polynucleotide
tctaagttcctccctaact

SEQ ID NO: 5453 - DNA, 20 bp, Artificial Sequence
  Synthetic Polynucleotide
gagtctgattatgaagcatt

SEQ ID NO: 5454 - DNA, 18 bp, Artificial Sequence
  Synthetic Polynucleotide
tgatctgataacccctct

SEQ ID NO: 5455 - DNA, 18 bp, Artificial Sequence
  Synthetic Polynucleotide
gctaaagcagcccaaaca

SEQ ID NO: 5456 - DNA, 19 bp, Artificial Sequence
  Synthetic Polynucleotide
cttcgttgaataaccatga

SEQ ID NO: 5457 - DNA, 18 bp, Artificial Sequence
  Synthetic Polynucleotide
tagcgaagccctgtacat

SEQ ID NO: 5458 - DNA, 20 bp, Artificial Sequence
  Synthetic Polynucleotide
gaaaccgtcgaagtcatagt

SEQ ID NO: 5459 - DNA, 19 bp, Artificial Sequence
  Synthetic Polynucleotide
atgaagagatgcccgaagt

SEQ ID NO: 5460 - DNA, 18 bp, Artificial Sequence
  Synthetic Polynucleotide
aaacttaaccccgttcca

SEQ ID NO: 5461 - DNA, 17 bp, Artificial Sequence
  Synthetic Polynucleotide
agttcacactttcccca

SEQ ID NO: 5462 - DNA, 18 bp, Artificial Sequence
  Synthetic Polynucleotide
tcgatttaattctcgtcc

SEQ ID NO: 5463 - DNA, 19 bp, Artificial Sequence
  Synthetic Polynucleotide
gactccgtcaaagaagtcg

SEQ ID NO: 5464 - DNA, 17 bp, Artificial Sequence
  Synthetic Polynucleotide
ttcagttacgtggtcgc

SEQ ID NO: 5465 - DNA, 17 bp, Artificial Sequence
  Synthetic Polynucleotide
gctgttcatagccctca

SEQ ID NO: 5466 - DNA, 18 bp, Artificial Sequence
  Synthetic Polynucleotide
cactctcaccctgtttgc

SEQ ID NO: 5467 - DNA, 17 bp, Artificial Sequence
  Synthetic Polynucleotide
tgctggaaacaaacgat

SEQ ID NO: 5468 - DNA, 18 bp, Artificial Sequence
  Synthetic Polynucleotide
atggctgtgaagaagaga

SEQ ID NO: 5469 - DNA, 20 bp, Artificial Sequence
  Synthetic Polynucleotide
aacacgctttcctcttgtcc

SEQ ID NO: 5470 - DNA, 20 bp, Artificial Sequence
  Synthetic Polynucleotide
ggagtacgatcctttgaaaa

SEQ ID NO: 5471 - DNA, 19 bp, Artificial Sequence
  Synthetic Polynucleotide
ctggtgtgggaacaactga

SEQ ID NO: 5472 - DNA, 19 bp, Artificial Sequence
  Synthetic Polynucleotide
gggcggtgaatgagatcca

SEQ ID NO: 5473 - DNA, 19 bp, Artificial Sequence
  Synthetic Polynucleotide
caccttagcttttaggctg

SEQ ID NO: 5474 - DNA, 18 bp, Artificial Sequence
  Synthetic Polynucleotide
tcttttggttgaatctga

SEQ ID NO: 5475 - DNA, 19 bp, Artificial Sequence
  Synthetic Polynucleotide
cgtaaaccttgtattttgc

SEQ ID NO: 5476 - DNA, 18 bp, Artificial Sequence
  Synthetic Polynucleotide
gatgagttgcattactgg

SEQ ID NO: 5477 - DNA, 19 bp, Artificial Sequence
  Synthetic Polynucleotide
gattttctattgtcgctgc

SEQ ID NO: 5478 - DNA, 17 bp, Artificial Sequence
  Synthetic Polynucleotide
cgttagcattgggcgga

SEQ ID NO: 5479 - DNA, 19 bp, Artificial Sequence
  Synthetic Polynucleotide
acatttatgggcagtaact

SEQ ID NO: 5480 - DNA, 20 bp, Artificial Sequence
  Synthetic Polynucleotide
tcaactagcacctattgcat

SEQ ID NO: 5481 - DNA, 18 bp, Artificial Sequence
  Synthetic Polynucleotide
ggactttgcgggagtagt

SEQ ID NO: 5482 - DNA, 18 bp, Artificial Sequence
  Synthetic Polynucleotide
cctagggatactgacgaa

SEQ ID NO: 5483 - DNA, 18 bp, Artificial Sequence
  Synthetic Polynucleotide
gggcacgtaagagaaggg

SEQ ID NO: 5484 - DNA, 19 bp, Artificial Sequence
  Synthetic Polynucleotide
ggtttgctaaagttagagg

SEQ ID NO: 5485 - DNA, 20 bp, Artificial Sequence
  Synthetic Polynucleotide
tgaaattttcgggtctattc

SEQ ID NO: 5486 - DNA, 19 bp, Artificial Sequence
  Synthetic Polynucleotide
gccacttagtcctgaactg

SEQ ID NO: 5487 - DNA, 17 bp, Artificial Sequence
  Synthetic Polynucleotide
tccagaatggctgtcct

SEQ ID NO: 5488 - DNA, 20 bp, Artificial Sequence
  Synthetic Polynucleotide
gtacatggaaaactacagac

SEQ ID NO: 5489 - DNA, 17 bp, Artificial Sequence
  Synthetic Polynucleotide
acagtcgaatcttgggt

SEQ ID NO: 5490 - DNA, 19 bp, Artificial Sequence
  Synthetic Polynucleotide
tgaagagaatttggacgaa

SEQ ID NO: 5491 - DNA, 19 bp, Artificial Sequence
  Synthetic Polynucleotide
tagattttgatcctctgcg

SEQ ID NO: 5492 - DNA, 20 bp, Artificial Sequence
  Synthetic Polynucleotide
gattgcacttgagaaaggga

SEQ ID NO: 5493 - DNA, 18 bp, Artificial Sequence
  Synthetic Polynucleotide
ctggggtaaatggtttcg

SEQ ID NO: 5494 - DNA, 19 bp, Artificial Sequence
  Synthetic Polynucleotide
gacgagtcctactagatga

SEQ ID NO: 5495 - DNA, 20 bp, Artificial Sequence
  Synthetic Polynucleotide
gtttcttaggctctttgatc

SEQ ID NO: 5496 - DNA, 20 bp, Artificial Sequence
  Synthetic Polynucleotide
tggagaatgagaacctatcc

SEQ ID NO: 5497 - DNA, 18 bp, Artificial Sequence
  Synthetic Polynucleotide
ggaagtgggtggtaggag

SEQ ID NO: 5498 - DNA, 19 bp, Artificial Sequence
  Synthetic Polynucleotide
cccgtggcattaaaataac

SEQ ID NO: 5499 - DNA, 19 bp, Artificial Sequence
  Synthetic Polynucleotide
tctttccaaatcacgattg

SEQ ID NO: 5500 - DNA, 19 bp, Artificial Sequence
  Synthetic Polynucleotide
aagagcctattgatgaagt

SEQ ID NO: 5501 - DNA, 18 bp, Artificial Sequence
  Synthetic Polynucleotide
gggtgatgtttccatagc

SEQ ID NO: 5502 - DNA, 20 bp, Artificial Sequence
  Synthetic Polynucleotide
tgagcaacatgacagcacca

SEQ ID NO: 5503 - DNA, 17 bp, Artificial Sequence
  Synthetic Polynucleotide
tagtccccacttcatta

SEQ ID NO: 5504 - DNA, 19 bp, Artificial Sequence
  Synthetic Polynucleotide
tttcgcttacaatgaggaa

SEQ ID NO: 5505 - DNA, 19 bp, Artificial Sequence
  Synthetic Polynucleotide
ctgagggcgtacactgttt

SEQ ID NO: 5506 - DNA, 18 bp, Artificial Sequence
  Synthetic Polynucleotide
aagaggcactaaaagtga

SEQ ID NO: 5507 - DNA, 17 bp, Artificial Sequence
  Synthetic Polynucleotide
ggcgtgctgtttcactg

SEQ ID NO: 5508 - DNA, 18 bp, Artificial Sequence
  Synthetic Polynucleotide
agaaggaaagtccatcct

SEQ ID NO: 5509 - DNA, 17 bp, Artificial Sequence
  Synthetic Polynucleotide
atcttcctctgcaatcc

SEQ ID NO: 5510 - DNA, 17 bp, Artificial Sequence
  Synthetic Polynucleotide
ccctgtgcgtgaatcca

SEQ ID NO: 5511 - DNA, 17 bp, Artificial Sequence
  Synthetic Polynucleotide
cacatttccatccgaac

SEQ ID NO: 5512 - DNA, 17 bp, Artificial Sequence
  Synthetic Polynucleotide
ttgccagtccctttggg

SEQ ID NO: 5513 - DNA, 17 bp, Artificial Sequence
  Synthetic Polynucleotide
cacgaagcgatgacaca

SEQ ID NO: 5514 - DNA, 17 bp, Artificial Sequence
  Synthetic Polynucleotide
gactaccacttcgttgc

SEQ ID NO: 5515 - DNA, 20 bp, Artificial Sequence
  Synthetic Polynucleotide
aagccagttcaaattaaagg

SEQ ID NO: 5516 - DNA, 18 bp, Artificial Sequence
  Synthetic Polynucleotide
ccctgtgcgtgaatccat

SEQ ID NO: 5517 - DNA, 17 bp, Artificial Sequence
  Synthetic Polynucleotide
ttccatccgaacattca

SEQ ID NO: 5518 - DNA, 17 bp, Artificial Sequence
  Synthetic Polynucleotide
tcatcaatgacgttgta

SEQ ID NO: 5519 - DNA, 19 bp, Artificial Sequence
  Synthetic Polynucleotide
atttccatccaaacattca

SEQ ID NO: 5520 - DNA, 20 bp, Artificial Sequence
  Synthetic Polynucleotide
atgagtacatgccatataca

SEQ ID NO: 5521 - DNA, 18 bp, Artificial Sequence
  Synthetic Polynucleotide
gctactgtgaagaacgat

SEQ ID NO: 5522 - DNA, 19 bp, Artificial Sequence
  Synthetic Polynucleotide
tcatcaatgacgttatacc

SEQ ID NO: 5523 - DNA, 17 bp, Artificial Sequence
  Synthetic Polynucleotide
tgaacttccaagtctgg

SEQ ID NO: 5524 - DNA, 17 bp, Artificial Sequence
  Synthetic Polynucleotide
tctaaccctgtgtatgc

SEQ ID NO: 5525 - DNA, 20 bp, Artificial Sequence
  Synthetic Polynucleotide
tctcagttagttaatcctcc

SEQ ID NO: 5526 - DNA, 18 bp, Artificial Sequence
  Synthetic Polynucleotide
gtggagatctatgttgca

SEQ ID NO: 5527 - DNA, 18 bp, Artificial Sequence
  Synthetic Polynucleotide
tatcagctttctcatgac

SEQ ID NO: 5528 - DNA, 19 bp, Artificial Sequence
  Synthetic Polynucleotide
agatctatgttgcatctga

SEQ ID NO: 5529 - DNA, 19 bp, Artificial Sequence
  Synthetic Polynucleotide
atcccctctatttcaagat

SEQ ID NO: 5530 - DNA, 17 bp, Artificial Sequence
  Synthetic Polynucleotide
aagcccaggatctatcg

SEQ ID NO: 5531 - DNA, 18 bp, Artificial Sequence
  Synthetic Polynucleotide
tccgtccatcagtaacaa

SEQ ID NO: 5532 - DNA, 20 bp, Artificial Sequence
  Synthetic Polynucleotide
gccactgacatctttacgat

SEQ ID NO: 5533 - DNA, 18 bp, Artificial Sequence
  Synthetic Polynucleotide
attcccactatcttcctc

SEQ ID NO: 5534 - DNA, 18 bp, Artificial Sequence
  Synthetic Polynucleotide
aacatttgtgaatcccca

SEQ ID NO: 5535 - DNA, 18 bp, Artificial Sequence
  Synthetic Polynucleotide
aaagagttgcgaatacag

SEQ ID NO: 5536 - DNA, 19 bp, Artificial Sequence
  Synthetic Polynucleotide
gaaataatggagatcgacg

SEQ ID NO: 5537 - DNA, 19 bp, Artificial Sequence
  Synthetic Polynucleotide
ctcctcctcatccaaccgt

SEQ ID NO: 5538 - DNA, 20 bp, Artificial Sequence
  Synthetic Polynucleotide
tattttgccagtaattatga

SEQ ID NO: 5539 - DNA, 17 bp, Artificial Sequence
  Synthetic Polynucleotide
cctgtaaatgcaactgg

SEQ ID NO: 5540 - DNA, 19 bp, Artificial Sequence
  Synthetic Polynucleotide
gaagaggagtagtagtgta

SEQ ID NO: 5541 - DNA, 17 bp, Artificial Sequence
  Synthetic Polynucleotide
atcgtgctttgcaatcc

SEQ ID NO: 5542 - DNA, 17 bp, Artificial Sequence
  Synthetic Polynucleotide
cccctgtgcgtgaatcc

SEQ ID NO: 5543 - DNA, 17 bp, Artificial Sequence
  Synthetic Polynucleotide
tggtacaacgtcattga

SEQ ID NO: 5544 - DNA, 17 bp, Artificial Sequence
  Synthetic Polynucleotide
ctgaacttcgacagccc

SEQ ID NO: 5545 - DNA, 19 bp, Artificial Sequence
  Synthetic Polynucleotide
cgcggccttttagatataa

SEQ ID NO: 5546 - DNA, 20 bp, Artificial Sequence
  Synthetic Polynucleotide
acgtggttttccatacttta

SEQ ID NO: 5547 - DNA, 18 bp, Artificial Sequence
  Synthetic Polynucleotide
tctttctctctctaccac

SEQ ID NO: 5548 - DNA, 18 bp, Artificial Sequence
  Synthetic Polynucleotide
cgttaaatgggacctggt

SEQ ID NO: 5549 - DNA, 17 bp, Artificial Sequence
  Synthetic Polynucleotide
tcaaagggaagctgaaa

SEQ ID NO: 5550 - DNA, 18 bp, Artificial Sequence
  Synthetic Polynucleotide
aggcgttttaattgttgg

SEQ ID NO: 5551 - DNA, 20 bp, Artificial Sequence
  Synthetic Polynucleotide
agttagcaaatcctccaaat

SEQ ID NO: 5552 - DNA, 19 bp, Artificial Sequence
  Synthetic Polynucleotide
tagtggagatctatgttgc

SEQ ID NO: 5553 - DNA, 17 bp, Artificial Sequence
  Synthetic Polynucleotide
ctctacatctgcggacc

SEQ ID NO: 5554 - DNA, 18 bp, Artificial Sequence
  Synthetic Polynucleotide
aaatcagactggcaacct

SEQ ID NO: 5555 - DNA, 20 bp, Artificial Sequence
  Synthetic Polynucleotide
gcattatgaagaattcgatc

SEQ ID NO: 5556 - DNA, 18 bp, Artificial Sequence
  Synthetic Polynucleotide
tttgagtttgtaacccca

SEQ ID NO: 5557 - DNA, 17 bp, Artificial Sequence
  Synthetic Polynucleotide
ggcgttcttgcttatgt

SEQ ID NO: 5558 - DNA, 17 bp, Artificial Sequence
  Synthetic Polynucleotide
gtccaatcatttcgctc

SEQ ID NO: 5559 - DNA, 17 bp, Artificial Sequence
  Synthetic Polynucleotide
ggaaccttccaaatcga

SEQ ID NO: 5560 - DNA, 17 bp, Artificial Sequence
  Synthetic Polynucleotide
cacatggttttacccgt

SEQ ID NO: 5561 - DNA, 17 bp, Artificial Sequence
  Synthetic Polynucleotide
cgtggacttttccgatc

SEQ ID NO: 5562 - DNA, 19 bp, Artificial Sequence
  Synthetic Polynucleotide
ctgatgaacattcgtatcg

SEQ ID NO: 5563 - DNA, 17 bp, Artificial Sequence
  Synthetic Polynucleotide
aagactggtcaaatccg

SEQ ID NO: 5564 - DNA, 17 bp, Artificial Sequence
  Synthetic Polynucleotide
gcgttttaagggaactc

SEQ ID NO: 5565 - DNA, 18 bp, Artificial Sequence
  Synthetic Polynucleotide
atgcttggtataacgtca

SEQ ID NO: 5566 - DNA, 20 bp, Artificial Sequence
  Synthetic Polynucleotide
ccacctttaatttgaattgg

SEQ ID NO: 5567 - DNA, 19 bp, Artificial Sequence
  Synthetic Polynucleotide
gtgctcaatcgcttattaa

SEQ ID NO: 5568 - DNA, 18 bp, Artificial Sequence
  Synthetic Polynucleotide
gtggttaatggagtgttc

SEQ ID NO: 5569 - DNA, 18 bp, Artificial Sequence
  Synthetic Polynucleotide
cgacaagagaatgacgga

SEQ ID NO: 5570 - DNA, 17 bp, Artificial Sequence
  Synthetic Polynucleotide
catctgatgggcttcct

SEQ ID NO: 5571 - DNA, 17 bp, Artificial Sequence
  Synthetic Polynucleotide
tcccctgtatttcaaga

SEQ ID NO: 5572 - DNA, 18 bp, Artificial Sequence
  Synthetic Polynucleotide
aagatatggatggacgag

SEQ ID NO: 5573 - DNA, 20 bp, Artificial Sequence
  Synthetic Polynucleotide
aactaaaacggtagaacaat

SEQ ID NO: 5574 - DNA, 17 bp, Artificial Sequence
  Synthetic Polynucleotide
ttttgaacggctgagat

SEQ ID NO: 5575 - DNA, 19 bp, Artificial Sequence
  Synthetic Polynucleotide
acacgacatgagattgacg

SEQ ID NO: 5576 - DNA, 20 bp, Artificial Sequence
  Synthetic Polynucleotide
taagcgatgtatcctcacaa

SEQ ID NO: 5577 - DNA, 18 bp, Artificial Sequence
  Synthetic Polynucleotide
ttacgagaatgccatttg

SEQ ID NO: 5578 - DNA, 17 bp, Artificial Sequence
  Synthetic Polynucleotide
tgatgagttcccctgtg

SEQ ID NO: 5579 - DNA, 19 bp, Artificial Sequence
  Synthetic Polynucleotide
tactcacccaagaaggtct

SEQ ID NO: 5580 - DNA, 18 bp, Artificial Sequence
  Synthetic Polynucleotide
aagatatggatggacgaa

SEQ ID NO: 5581 - DNA, 20 bp, Artificial Sequence
  Synthetic Polynucleotide
agtgcaaagagtgccaacaa

SEQ ID NO: 5582 - DNA, 19 bp, Artificial Sequence
  Synthetic Polynucleotide
gatgggctgtagctgacac

SEQ ID NO: 5583 - DNA, 20 bp, Artificial Sequence
  Synthetic Polynucleotide
cgtgatgaatatcaactgtc

SEQ ID NO: 5584 - DNA, 17 bp, Artificial Sequence
  Synthetic Polynucleotide
tcaatgacgcaatgatc

SEQ ID NO: 5585 - DNA, 19 bp, Artificial Sequence
  Synthetic Polynucleotide
gaatgacagacaacgaatc

SEQ ID NO: 5586 - DNA, 18 bp, Artificial Sequence
  Synthetic Polynucleotide
gggtcctctgatgaacat

SEQ ID NO: 5587 - DNA, 19 bp, Artificial Sequence
  Synthetic Polynucleotide
gcaacatagatctccacta

SEQ ID NO: 5588 - DNA, 19 bp, Artificial Sequence
  Synthetic Polynucleotide
ccgatgctatgtctaaggc

SEQ ID NO: 5589 - DNA, 19 bp, Artificial Sequence
  Synthetic Polynucleotide
gttgcaaatccctttaatg

SEQ ID NO: 5590 - DNA, 19 bp, Artificial Sequence
  Synthetic Polynucleotide
aaaacgccttgttaattta

SEQ ID NO: 5591 - DNA, 19 bp, Artificial Sequence
  Synthetic Polynucleotide
gctgtatgaaaattgacca

SEQ ID NO: 5592 - DNA, 19 bp, Artificial Sequence
  Synthetic Polynucleotide
ggacaacttcaatttccct

SEQ ID NO: 5593 - DNA, 20 bp, Artificial Sequence
  Synthetic Polynucleotide
ctcatacctccacccaattc

SEQ ID NO: 5594 - DNA, 20 bp, Artificial Sequence
  Synthetic Polynucleotide
cctttaatttgaactggctt

SEQ ID NO: 5595 - DNA, 17 bp, Artificial Sequence
  Synthetic Polynucleotide
atgcatgaagatcgacc

SEQ ID NO: 5596 - DNA, 20 bp, Artificial Sequence
  Synthetic Polynucleotide
tccaacaacacttctatccc

SEQ ID NO: 5597 - DNA, 17 bp, Artificial Sequence
  Synthetic Polynucleotide
gcaccaacagtgaagat

SEQ ID NO: 5598 - DNA, 20 bp, Artificial Sequence
  Synthetic Polynucleotide
ataatataagcaagaacgcc

SEQ ID NO: 5599 - DNA, 18 bp, Artificial Sequence
  Synthetic Polynucleotide
agctgtctagggatagag

SEQ ID NO: 5600 - DNA, 17 bp, Artificial Sequence
  Synthetic Polynucleotide
ttccgtcttggtgagtc

SEQ ID NO: 5601 - DNA, 17 bp, Artificial Sequence
  Synthetic Polynucleotide
cggcaaatgggagagaa

SEQ ID NO: 5602 - DNA, 18 bp, Artificial Sequence
  Synthetic Polynucleotide
gttgatcgtaaaccacat

SEQ ID NO: 5603 - DNA, 20 bp, Artificial Sequence
  Synthetic Polynucleotide
ctgttcaaatcatgggcaaa

SEQ ID NO: 5604 - DNA, 20 bp, Artificial Sequence
  Synthetic Polynucleotide
acttgggagaagtggggaaa

SEQ ID NO: 5605 - DNA, 20 bp, Artificial Sequence
  Synthetic Polynucleotide
tgttcacttttgtaggatgc

SEQ ID NO: 5606 - DNA, 19 bp, Artificial Sequence
  Synthetic Polynucleotide
atattccggctattttggc

SEQ ID NO: 5607 - DNA, 20 bp, Artificial Sequence
  Synthetic Polynucleotide
cattggaatgttataaggca

SEQ ID NO: 5608 - DNA, 19 bp, Artificial Sequence
  Synthetic Polynucleotide
aagggaacgtcaaagttac

SEQ ID NO: 5609 - DNA, 20 bp, Artificial Sequence
  Synthetic Polynucleotide
tttgtgttaatgaggctata

SEQ ID NO: 5610 - DNA, 19 bp, Artificial Sequence
  Synthetic Polynucleotide
cgcaatcttaaccgttgaa

SEQ ID NO: 5611 - DNA, 17 bp, Artificial Sequence
  Synthetic Polynucleotide
agacttttggagccaga

SEQ ID NO: 5612 - DNA, 20 bp, Artificial Sequence
  Synthetic Polynucleotide
tgatgtagaggaaaggaaat

SEQ ID NO: 5613 - DNA, 17 bp, Artificial Sequence
  Synthetic Polynucleotide
aagcacgtattgacctc

SEQ ID NO: 5614 - DNA, 17 bp, Artificial Sequence
  Synthetic Polynucleotide
acgctattccgaaggaa

SEQ ID NO: 5615 - DNA, 20 bp, Artificial Sequence
  Synthetic Polynucleotide
gtctttatttgggaggtgcg

SEQ ID NO: 5616 - DNA, 19 bp, Artificial Sequence
  Synthetic Polynucleotide
catcactcatagagttggt

SEQ ID NO: 5617 - DNA, 18 bp, Artificial Sequence
  Synthetic Polynucleotide
tggaaccaggtaactacc

SEQ ID NO: 5618 - DNA, 17 bp, Artificial Sequence
  Synthetic Polynucleotide
cgaagtggggaaacact

SEQ ID NO: 5619 - DNA, 20 bp, Artificial Sequence
  Synthetic Polynucleotide
caggggcaacttcatcatat

SEQ ID NO: 5620 - DNA, 20 bp, Artificial Sequence
  Synthetic Polynucleotide
cccttaagaaatgaccagtc

SEQ ID NO: 5621 - DNA, 20 bp, Artificial Sequence
  Synthetic Polynucleotide
tcaacagacaattttcttgt

SEQ ID NO: 5622 - DNA, 17 bp, Artificial Sequence
  Synthetic Polynucleotide
tgcgttgggaggattta

SEQ ID NO: 5623 - DNA, 18 bp, Artificial Sequence
  Synthetic Polynucleotide
agaatgcagaattcgtct

SEQ ID NO: 5624 - DNA, 20 bp, Artificial Sequence
  Synthetic Polynucleotide
ttgttgacactaataatgcc

SEQ ID NO: 5625 - DNA, 18 bp, Artificial Sequence
  Synthetic Polynucleotide
cttgttggaaacagttga

SEQ ID NO: 5626 - DNA, 20 bp, Artificial Sequence
  Synthetic Polynucleotide
ctgcgtagctgaagaacctt

SEQ ID NO: 5627 - DNA, 19 bp, Artificial Sequence
  Synthetic Polynucleotide
aacatcttagaaatcgtcg

SEQ ID NO: 5628 - DNA, 20 bp, Artificial Sequence
  Synthetic Polynucleotide
actatatggaaggatactgg

SEQ ID NO: 5629 - DNA, 20 bp, Artificial Sequence
  Synthetic Polynucleotide
tcagaggacatctcattgca

SEQ ID NO: 5630 - DNA, 17 bp, Artificial Sequence
  Synthetic Polynucleotide
tccacatgggagaagtc

SEQ ID NO: 5631 - DNA, 18 bp, Artificial Sequence
  Synthetic Polynucleotide
tgttgagtcgcacaggga

SEQ ID NO: 5632 - DNA, 20 bp, Artificial Sequence
  Synthetic Polynucleotide
cgtgcagcatctgtaattta

SEQ ID NO: 5633 - DNA, 18 bp, Artificial Sequence
  Synthetic Polynucleotide
acaaagggttacaaggag

SEQ ID NO: 5634 - DNA, 19 bp, Artificial Sequence
  Synthetic Polynucleotide
catggtacactgacaggtc

SEQ ID NO: 5635 - DNA, 17 bp, Artificial Sequence
  Synthetic Polynucleotide
ccaactaccgccccaac

SEQ ID NO: 5636 - DNA, 19 bp, Artificial Sequence
  Synthetic Polynucleotide
ctatccgtagtctttaccc

SEQ ID NO: 5637 - DNA, 19 bp, Artificial Sequence
  Synthetic Polynucleotide
ataatgtccaccttgtcgt

SEQ ID NO: 5638 - DNA, 19 bp, Artificial Sequence
  Synthetic Polynucleotide
agatgtcctaaatctccta

SEQ ID NO: 5639 - DNA, 17 bp, Artificial Sequence
  Synthetic Polynucleotide
tttatgcctacagcctc

SEQ ID NO: 5640 - DNA, 17 bp, Artificial Sequence
  Synthetic Polynucleotide
gtggtggacttctctca

SEQ ID NO: 5641 - DNA, 17 bp, Artificial Sequence
  Synthetic Polynucleotide
cgagggagttcttcttc

SEQ ID NO: 5642 - DNA, 17 bp, Artificial Sequence
  Synthetic Polynucleotide
ggagtgtggattcgcac

SEQ ID NO: 5643 - DNA, 17 bp, Artificial Sequence
  Synthetic Polynucleotide
ggccagctagtattccc

SEQ ID NO: 5644 - DNA, 18 bp, Artificial Sequence
  Synthetic Polynucleotide
ccattgaagcaatcacta

SEQ ID NO: 5645 - DNA, 18 bp, Artificial Sequence
  Synthetic Polynucleotide
tatgcctacagcctccta

SEQ ID NO: 5646 - DNA, 20 bp, Artificial Sequence
  Synthetic Polynucleotide
tgcctcatcttcttgttggt

SEQ ID NO: 5647 - DNA, 17 bp, Artificial Sequence
  Synthetic Polynucleotide
taaagggacagcaacca

SEQ ID NO: 5648 - DNA, 18 bp, Artificial Sequence
  Synthetic Polynucleotide
accctgtacaatcagcgg

SEQ ID NO: 5649 - DNA, 17 bp, Artificial Sequence
  Synthetic Polynucleotide
tgagtgccgtatggtga

SEQ ID NO: 5650 - DNA, 19 bp, Artificial Sequence
  Synthetic Polynucleotide
tctgcctaatcatctcttg

SEQ ID NO: 5651 - DNA, 17 bp, Artificial Sequence
  Synthetic Polynucleotide
gccgacgaaatcaattc

SEQ ID NO: 5652 - DNA, 17 bp, Artificial Sequence
  Synthetic Polynucleotide
gtggtttctggggtgac

SEQ ID NO: 5653 - DNA, 17 bp, Artificial Sequence
  Synthetic Polynucleotide
tggggcagatcgacgac

SEQ ID NO: 5654 - DNA, 18 bp, Artificial Sequence
  Synthetic Polynucleotide
tgcttctgcctatgctgc

SEQ ID NO: 5655 - DNA, 19 bp, Artificial Sequence
  Synthetic Polynucleotide
cctattaatggagcgtgga

SEQ ID NO: 5656 - DNA, 18 bp, Artificial Sequence
  Synthetic Polynucleotide
gccagggtaagaatggac

SEQ ID NO: 5657 - DNA, 19 bp, Artificial Sequence
  Synthetic Polynucleotide
gttggttgtcatagtcctg

SEQ ID NO: 5658 - DNA, 18 bp, Artificial Sequence
  Synthetic Polynucleotide
tttcctgcgaaagttaac

SEQ ID NO: 5659 - DNA, 18 bp, Artificial Sequence
  Synthetic Polynucleotide
ggaatgtttccgttgata

SEQ ID NO: 5660 - DNA, 17 bp, Artificial Sequence
  Synthetic Polynucleotide
tttgaacgaggcactgc

SEQ ID NO: 5661 - DNA, 17 bp, Artificial Sequence
  Synthetic Polynucleotide
agggttagggttagggt

SEQ ID NO: 5662 - DNA, 17 bp, Artificial Sequence
  Synthetic Polynucleotide
ccctaaccctaacccta

SEQ ID NO: 5663 - DNA, 18 bp, Artificial Sequence
  Synthetic Polynucleotide
ggcgttgtaaaagtagta

SEQ ID NO: 5664 - DNA, 18 bp, Artificial Sequence
  Synthetic Polynucleotide
cgacaaggtcaagtccct

SEQ ID NO: 5665 - DNA, 18 bp, Artificial Sequence
  Synthetic Polynucleotide
gggctcatgctagagtat

SEQ ID NO: 5666 - DNA, 17 bp, Artificial Sequence
  Synthetic Polynucleotide
tcatccaggcccacaac

SEQ ID NO: 5667 - DNA, 17 bp, Artificial Sequence
  Synthetic Polynucleotide
ccacacctacgagtccc

SEQ ID NO: 5668 - DNA, 20 bp, Artificial Sequence
  Synthetic Polynucleotide
gttccttagtgacatccacg

SEQ ID NO: 5669 - DNA, 20 bp, Artificial Sequence
  Synthetic Polynucleotide
atcaatgactttactgaagc

SEQ ID NO: 5670 - DNA, 18 bp, Artificial Sequence
  Synthetic Polynucleotide
ccaagatcaggatatcgg

SEQ ID NO: 5671 - DNA, 17 bp, Artificial Sequence
  Synthetic Polynucleotide
tcacggtctccgctatg

SEQ ID NO: 5672 - DNA, 18 bp, Artificial Sequence
  Synthetic Polynucleotide
tcgtccccatagacatgt

SEQ ID NO: 5673 - DNA, 17 bp, Artificial Sequence
  Synthetic Polynucleotide
gctcctgctaaaactgt

SEQ ID NO: 5674 - DNA, 17 bp, Artificial Sequence
  Synthetic Polynucleotide
ctcctcctcctcctcct

SEQ ID NO: 5675 - DNA, 17 bp, Artificial Sequence
  Synthetic Polynucleotide
ttgcagaagttgctcca

SEQ ID NO: 5676 - DNA, 17 bp, Artificial Sequence
  Synthetic Polynucleotide
agttctgccagcaccag

SEQ ID NO: 5677 - DNA, 17 bp, Artificial Sequence
  Synthetic Polynucleotide
agcagctccccatcaaa

SEQ ID NO: 5678 - DNA, 18 bp, Artificial Sequence
  Synthetic Polynucleotide
ttttgcgaccccatgtgc

SEQ ID NO: 5679 - DNA, 20 bp, Artificial Sequence
  Synthetic Polynucleotide
ttccatttgcattctacgtt

SEQ ID NO: 5680 - DNA, 19 bp, Artificial Sequence
  Synthetic Polynucleotide
tctgtcatcatgtaccaaa

SEQ ID NO: 5681 - DNA, 17 bp, Artificial Sequence
  Synthetic Polynucleotide
agtcgtcgatctcgggc

SEQ ID NO: 5682 - DNA, 18 bp, Artificial Sequence
  Synthetic Polynucleotide
cgaagctcaggttgtacc

SEQ ID NO: 5683 - DNA, 18 bp, Artificial Sequence
  Synthetic Polynucleotide
gccgctcatgttgtactg

SEQ ID NO: 5684 - DNA, 17 bp, Artificial Sequence
  Synthetic Polynucleotide
ttctacatcatcgaggc

SEQ ID NO: 5685 - DNA, 17 bp, Artificial Sequence
  Synthetic Polynucleotide
tcctcttcctcctcttc

SEQ ID NO: 5686 - DNA, 19 bp, Artificial Sequence
  Synthetic Polynucleotide
tgtaccattttcatcctct

SEQ ID NO: 5687 - DNA, 20 bp, Artificial Sequence
  Synthetic Polynucleotide
agtcttttcatttccagaca

SEQ ID NO: 5688 - DNA, 20 bp, Artificial Sequence
  Synthetic Polynucleotide
tcaagagtagagttccagtt

SEQ ID NO: 5689 - DNA, 18 bp, Artificial Sequence
  Synthetic Polynucleotide
tgttcgctatgggaaacc

SEQ ID NO: 5690 - DNA, 19 bp, Artificial Sequence
  Synthetic Polynucleotide
cgtgtttgcttttggtgtg

SEQ ID NO: 5691 - DNA, 20 bp, Artificial Sequence
  Synthetic Polynucleotide
ctacgtctatgcaaccgaag

SEQ ID NO: 5692 - DNA, 17 bp, Artificial Sequence
  Synthetic Polynucleotide
cgctctcttcctcacgc

SEQ ID NO: 5693 - DNA, 18 bp, Artificial Sequence
  Synthetic Polynucleotide
aatgaggtcacatggtac

SEQ ID NO: 5694 - DNA, 17 bp, Artificial Sequence
  Synthetic Polynucleotide
actttcgcacccttgag

SEQ ID NO: 5695 - DNA, 19 bp, Artificial Sequence
  Synthetic Polynucleotide
tccgtacccttatggtcat

SEQ ID NO: 5696 - DNA, 18 bp, Artificial Sequence
  Synthetic Polynucleotide
gcgccttctgcaactcta

SEQ ID NO: 5697 - DNA, 18 bp, Artificial Sequence
  Synthetic Polynucleotide
ttcaatctcgtaccgatt

SEQ ID NO: 5698 - DNA, 19 bp, Artificial Sequence
  Synthetic Polynucleotide
tgtaaaatctgcccgagcc

SEQ ID NO: 5699 - DNA, 17 bp, Artificial Sequence
  Synthetic Polynucleotide
cggacaaataagacccc

SEQ ID NO: 5700 - DNA, 19 bp, Artificial Sequence
  Synthetic Polynucleotide
ctacttctccaagagtgtt

SEQ ID NO: 5701 - DNA, 18 bp, Artificial Sequence
  Synthetic Polynucleotide
cgctgtctgcctatgcat

SEQ ID NO: 5702 - DNA, 18 bp, Artificial Sequence
  Synthetic Polynucleotide
tgctggattctgtactcg

SEQ ID NO: 5703 - DNA, 19 bp, Artificial Sequence
  Synthetic Polynucleotide
ctctgtcttgatgcttttg

SEQ ID NO: 5704 - DNA, 17 bp, Artificial Sequence
  Synthetic Polynucleotide
acccgctacatacaacg

SEQ ID NO: 5705 - DNA, 17 bp, Artificial Sequence
  Synthetic Polynucleotide
aacatcatcaacccctc

SEQ ID NO: 5706 - DNA, 17 bp, Artificial Sequence
  Synthetic Polynucleotide
cgccccgctcaattcat

SEQ ID NO: 5707 - DNA, 17 bp, Artificial Sequence
  Synthetic Polynucleotide
tgtagacgatcctacgt

SEQ ID NO: 5708 - DNA, 17 bp, Artificial Sequence
  Synthetic Polynucleotide
ttggtggtaggcgtgta

SEQ ID NO: 5709 - DNA, 17 bp, Artificial Sequence
  Synthetic Polynucleotide
ggtctctggacatccat

SEQ ID NO: 5710 - DNA, 19 bp, Artificial Sequence
  Synthetic Polynucleotide
caactggatttgccccaaa

SEQ ID NO: 5711 - DNA, 17 bp, Artificial Sequence
  Synthetic Polynucleotide
aagagaggtggaccaaa

SEQ ID NO: 5712 - DNA, 20 bp, Artificial Sequence
  Synthetic Polynucleotide
gagccatgcgttcataaagg

SEQ ID NO: 5713 - DNA, 19 bp, Artificial Sequence
  Synthetic Polynucleotide
gccattaccttaactccat

SEQ ID NO: 5714 - DNA, 17 bp, Artificial Sequence
  Synthetic Polynucleotide
attcgggatgcttatcc

SEQ ID NO: 5715 - DNA, 20 bp, Artificial Sequence
  Synthetic Polynucleotide
cccgttccgttgatttggaa

SEQ ID NO: 5716 - DNA, 18 bp, Artificial Sequence
  Synthetic Polynucleotide
ttgggtttccagttctac

SEQ ID NO: 5717 - DNA, 20 bp, Artificial Sequence
  Synthetic Polynucleotide
ccagctacaattttatcctg

SEQ ID NO: 5718 - DNA, 20 bp, Artificial Sequence
  Synthetic Polynucleotide
tccgttattattgcgtttcc

SEQ ID NO: 5719 - DNA, 19 bp, Artificial Sequence
  Synthetic Polynucleotide
accgtaagtcgatcagatg

SEQ ID NO: 5720 - DNA, 19 bp, Artificial Sequence
  Synthetic Polynucleotide
gtggctagattacttgctc

SEQ ID NO: 5721 - DNA, 19 bp, Artificial Sequence
  Synthetic Polynucleotide
accaacaccactcgctaat

SEQ ID NO: 5722 - DNA, 20 bp, Artificial Sequence
  Synthetic Polynucleotide
tttgcgttgaaattacaaaa

SEQ ID NO: 5723 - DNA, 17 bp, Artificial Sequence
  Synthetic Polynucleotide
accaccaccagtatcac

SEQ ID NO: 5724 - DNA, 20 bp, Artificial Sequence
  Synthetic Polynucleotide
atgaagaaccttctgaacaa

SEQ ID NO: 5725 - DNA, 18 bp, Artificial Sequence
  Synthetic Polynucleotide
cttgaaccagtccacgat

SEQ ID NO: 5726 - DNA, 18 bp, Artificial Sequence
  Synthetic Polynucleotide
cgtctcgtcatcttgatc

SEQ ID NO: 5727 - DNA, 17 bp, Artificial Sequence
  Synthetic Polynucleotide
cacatcaccatcagcac

SEQ ID NO: 5728 - DNA, 17 bp, Artificial Sequence
  Synthetic Polynucleotide
ctgtacccctaccaagc

SEQ ID NO: 5729 - DNA, 20 bp, Artificial Sequence
  Synthetic Polynucleotide
caggaagtgaagtttgtatc

SEQ ID NO: 5730 - DNA, 18 bp, Artificial Sequence
  Synthetic Polynucleotide
gcgggctttgttaccaat

SEQ ID NO: 5731 - DNA, 18 bp, Artificial Sequence
  Synthetic Polynucleotide
ccgcactcatgctctgct

SEQ ID NO: 5732 - DNA, 20 bp, Artificial Sequence
  Synthetic Polynucleotide
cgcagattcagtcggctatc

SEQ ID NO: 5733 - DNA, 20 bp, Artificial Sequence
  Synthetic Polynucleotide
taattgcttgatacgtttgt

SEQ ID NO: 5734 - DNA, 18 bp, Artificial Sequence
  Synthetic Polynucleotide
caccacaagttacacaaa

SEQ ID NO: 5735 - DNA, 18 bp, Artificial Sequence
  Synthetic Polynucleotide
aaaacctccggctcattt

SEQ ID NO: 5736 - DNA, 20 bp, Artificial Sequence
  Synthetic Polynucleotide
tctcgttattgttgaaattg

SEQ ID NO: 5737 - DNA, 17 bp, Artificial Sequence
  Synthetic Polynucleotide
caggcacaatactctgg

SEQ ID NO: 5738 - DNA, 20 bp, Artificial Sequence
  Synthetic Polynucleotide
aatttcgctatttcttggcc

SEQ ID NO: 5739 - DNA, 18 bp, Artificial Sequence
  Synthetic Polynucleotide
caacaactcctatcagga

SEQ ID NO: 5740 - DNA, 20 bp, Artificial Sequence
  Synthetic Polynucleotide
gggatctccatgattatttt

SEQ ID NO: 5741 - DNA, 19 bp, Artificial Sequence
  Synthetic Polynucleotide
attgcttaggaaaagaaga

SEQ ID NO: 5742 - DNA, 17 bp, Artificial Sequence
  Synthetic Polynucleotide
cgagatgttcctcggcc

SEQ ID NO: 5743 - DNA, 20 bp, Artificial Sequence
  Synthetic Polynucleotide
cgaataggattgtttcatca

SEQ ID NO: 5744 - DNA, 19 bp, Artificial Sequence
  Synthetic Polynucleotide
tagtttccttggacggaac

SEQ ID NO: 5745 - DNA, 19 bp, Artificial Sequence
  Synthetic Polynucleotide
agcgggacgtttggaagtc

SEQ ID NO: 5746 - DNA, 18 bp, Artificial Sequence
  Synthetic Polynucleotide
gataccgcatcatcgagc

SEQ ID NO: 5747 - DNA, 17 bp, Artificial Sequence
  Synthetic Polynucleotide
cgcagagcacctgaaca

SEQ ID NO: 5748 - DNA, 20 bp, Artificial Sequence
  Synthetic Polynucleotide
tgtttgatgtcacaccaatg

SEQ ID NO: 5749 - DNA, 18 bp, Artificial Sequence
  Synthetic Polynucleotide
aaatgctaaggctgaagg

SEQ ID NO: 5750 - DNA, 20 bp, Artificial Sequence
  Synthetic Polynucleotide
gtgaattagccataggagta

SEQ ID NO: 5751 - DNA, 18 bp, Artificial Sequence
  Synthetic Polynucleotide
atagtttgagtccgtgtc

SEQ ID NO: 5752 - DNA, 20 bp, Artificial Sequence
  Synthetic Polynucleotide
accgtgtacaagtccatctt

SEQ ID NO: 5753 - DNA, 18 bp, Artificial Sequence
  Synthetic Polynucleotide
atcacccaagagagctaa

SEQ ID NO: 5754 - DNA, 19 bp, Artificial Sequence
  Synthetic Polynucleotide
aatcaatgccgatacttac

SEQ ID NO: 5755 - DNA, 20 bp, Artificial Sequence
  Synthetic Polynucleotide
ccagtgccaacagtttgaat

SEQ ID NO: 5756 - DNA, 20 bp, Artificial Sequence
  Synthetic Polynucleotide
acgagacgtgaatttaaaat

SEQ ID NO: 5757 - DNA, 20 bp, Artificial Sequence
  Synthetic Polynucleotide
tgcctgaaccaatttatagt

SEQ ID NO: 5758 - DNA, 20 bp, Artificial Sequence
  Synthetic Polynucleotide
ttctccagattccatactta

SEQ ID NO: 5759 - DNA, 18 bp, Artificial Sequence
  Synthetic Polynucleotide
cgctggtggagcaatcaa

SEQ ID NO: 5760 - DNA, 18 bp, Artificial Sequence
  Synthetic Polynucleotide
ttaccactcattggagag

SEQ ID NO: 5761 - DNA, 17 bp, Artificial Sequence
  Synthetic Polynucleotide
aaacaaaccgttgccgt

SEQ ID NO: 5762 - DNA, 17 bp, Artificial Sequence
  Synthetic Polynucleotide
cacaagggttcaagttg

SEQ ID NO: 5763 - DNA, 18 bp, Artificial Sequence
  Synthetic Polynucleotide
gaaagtgtagccattacc

SEQ ID NO: 5764 - DNA, 20 bp, Artificial Sequence
  Synthetic Polynucleotide
acttcaaataaagcagtcac

SEQ ID NO: 5765 - DNA, 17 bp, Artificial Sequence
  Synthetic Polynucleotide
ttgctgtaaagtcgtca

SEQ ID NO: 5766 - DNA, 20 bp, Artificial Sequence
  Synthetic Polynucleotide
aacaaagaagttcaactctt

SEQ ID NO: 5767 - DNA, 19 bp, Artificial Sequence
  Synthetic Polynucleotide
ggcgtatgtagaaaggtgt

SEQ ID NO: 5768 - DNA, 18 bp, Artificial Sequence
  Synthetic Polynucleotide
aacaaatgtccgatccaa

SEQ ID NO: 5769 - DNA, 19 bp, Artificial Sequence
  Synthetic Polynucleotide
agtatgatgaaaaccgcat

SEQ ID NO: 5770 - DNA, 20 bp, Artificial Sequence
  Synthetic Polynucleotide
tgattcacatcacgtcttac

SEQ ID NO: 5771 - DNA, 18 bp, Artificial Sequence
  Synthetic Polynucleotide
accgttactcgtcttgcg

SEQ ID NO: 5772 - DNA, 19 bp, Artificial Sequence
  Synthetic Polynucleotide
ggtcatagacctgactagc

SEQ ID NO: 5773 - DNA, 19 bp, Artificial Sequence
  Synthetic Polynucleotide
ggggtggtagctaatggtg

SEQ ID NO: 5774 - DNA, 20 bp, Artificial Sequence
  Synthetic Polynucleotide
tggatgacatggctggtcta

SEQ ID NO: 5775 - DNA, 18 bp, Artificial Sequence
  Synthetic Polynucleotide
aacggaaagacaatgtga

SEQ ID NO: 5776 - DNA, 20 bp, Artificial Sequence
  Synthetic Polynucleotide
tgacgtattccttttctcct

SEQ ID NO: 5777 - DNA, 17 bp, Artificial Sequence
  Synthetic Polynucleotide
tatactcatggtaggcc

SEQ ID NO: 5778 - DNA, 17 bp, Artificial Sequence
  Synthetic Polynucleotide
atcaactggtagcccgg

SEQ ID NO: 5779 - DNA, 20 bp, Artificial Sequence
  Synthetic Polynucleotide
attttatactcatggtaggc

SEQ ID NO: 5780 - DNA, 19 bp, Artificial Sequence
  Synthetic Polynucleotide
gatgctcgaagacgacatg

SEQ ID NO: 5781 - DNA, 17 bp, Artificial Sequence
  Synthetic Polynucleotide
tgttcccacttaagcgc

SEQ ID NO: 5782 - DNA, 18 bp, Artificial Sequence
  Synthetic Polynucleotide
cgagaagaagatcatgca

SEQ ID NO: 5783 - DNA, 19 bp, Artificial Sequence
  Synthetic Polynucleotide
tcatttcctttcccaacgg

SEQ ID NO: 5784 - DNA, 17 bp, Artificial Sequence
  Synthetic Polynucleotide
tctggttttgaatcccc

SEQ ID NO: 5785 - DNA, 19 bp, Artificial Sequence
  Synthetic Polynucleotide
acaataaagaaggaggcat

SEQ ID NO: 5786 - DNA, 20 bp, Artificial Sequence
  Synthetic Polynucleotide
ccaaataggtagacgaggaa

SEQ ID NO: 5787 - DNA, 17 bp, Artificial Sequence
  Synthetic Polynucleotide
cggattgtacccgtgga

SEQ ID NO: 5788 - DNA, 17 bp, Artificial Sequence
  Synthetic Polynucleotide
gacatggaggtgagaaa

SEQ ID NO: 5789 - DNA, 17 bp, Artificial Sequence
  Synthetic Polynucleotide
gagtattccagagctga

SEQ ID NO: 5790 - DNA, 18 bp, Artificial Sequence
  Synthetic Polynucleotide
tgaactgaaatccctgcg

SEQ ID NO: 5791 - DNA, 17 bp, Artificial Sequence
  Synthetic Polynucleotide
aggaggtggaagaggcc

SEQ ID NO: 5792 - DNA, 19 bp, Artificial Sequence
  Synthetic Polynucleotide
taatcgacaaggtagtctc

SEQ ID NO: 5793 - DNA, 19 bp, Artificial Sequence
  Synthetic Polynucleotide
acatttgcacgaaattcaa

SEQ ID NO: 5794 - DNA, 18 bp, Artificial Sequence
  Synthetic Polynucleotide
ggtctattgtctgcaata

SEQ ID NO: 5795 - DNA, 19 bp, Artificial Sequence
  Synthetic Polynucleotide
ggaatcatggtttgtgacc

SEQ ID NO: 5796 - DNA, 17 bp, Artificial Sequence
  Synthetic Polynucleotide
gtccgaagagaacttcc

SEQ ID NO: 5797 - DNA, 18 bp, Artificial Sequence
  Synthetic Polynucleotide
tcaatgtgaccctcgcca

SEQ ID NO: 5798 - DNA, 19 bp, Artificial Sequence
  Synthetic Polynucleotide
aattggactgattacacca

SEQ ID NO: 5799 - DNA, 17 bp, Artificial Sequence
  Synthetic Polynucleotide
aataagcaatgacggca

SEQ ID NO: 5800 - DNA, 18 bp, Artificial Sequence
  Synthetic Polynucleotide
aatcgaagtggactgctg

SEQ ID NO: 5801 - DNA, 17 bp, Artificial Sequence
  Synthetic Polynucleotide
aaccgcctacataccag

SEQ ID NO: 5802 - DNA, 18 bp, Artificial Sequence
  Synthetic Polynucleotide
ttcctgctcctgttgagt

SEQ ID NO: 5803 - DNA, 17 bp, Artificial Sequence
  Synthetic Polynucleotide
gctcctgaaaagccatt

SEQ ID NO: 5804 - DNA, 18 bp, Artificial Sequence
  Synthetic Polynucleotide
tctcctcaaggaaatctt

SEQ ID NO: 5805 - DNA, 17 bp, Artificial Sequence
  Synthetic Polynucleotide
gccaataccatcagctt

SEQ ID NO: 5806 - DNA, 18 bp, Artificial Sequence
  Synthetic Polynucleotide
gcgacttcacgccagaat

SEQ ID NO: 5807 - DNA, 19 bp, Artificial Sequence
  Synthetic Polynucleotide
ggtaatttgttccgcctct

SEQ ID NO: 5808 - DNA, 19 bp, Artificial Sequence
  Synthetic Polynucleotide
tataagacccataaaagcc

SEQ ID NO: 5809 - DNA, 19 bp, Artificial Sequence
  Synthetic Polynucleotide
tactacctgaaactccacc

SEQ ID NO: 5810 - DNA, 19 bp, Artificial Sequence
  Synthetic Polynucleotide
attggacctgttgatgctg

SEQ ID NO: 5811 - DNA, 18 bp, Artificial Sequence
  Synthetic Polynucleotide
cttcacggttgatttcca

SEQ ID NO: 5812 - DNA, 17 bp, Artificial Sequence
  Synthetic Polynucleotide
gctgaaggtatggctac

SEQ ID NO: 5813 - DNA, 19 bp, Artificial Sequence
  Synthetic Polynucleotide
gataaggtcatcggtcggg

SEQ ID NO: 5814 - DNA, 19 bp, Artificial Sequence
  Synthetic Polynucleotide
gactcctgacaatggcaaa

SEQ ID NO: 5815 - DNA, 17 bp, Artificial Sequence
  Synthetic Polynucleotide
gatcagatcatcctcgg

SEQ ID NO: 5816 - DNA, 20 bp, Artificial Sequence
  Synthetic Polynucleotide
aggactcgatctgaagggca

SEQ ID NO: 5817 - DNA, 18 bp, Artificial Sequence
  Synthetic Polynucleotide
actttccaccagttagca

SEQ ID NO: 5818 - DNA, 20 bp, Artificial Sequence
  Synthetic Polynucleotide
ggttctacagtaatggaaaa

SEQ ID NO: 5819 - DNA, 19 bp, Artificial Sequence
  Synthetic Polynucleotide
gtcggatttgcgtttcttc

SEQ ID NO: 5820 - DNA, 20 bp, Artificial Sequence
  Synthetic Polynucleotide
gcggtgaaaatgtttaaaac

SEQ ID NO: 5821 - DNA, 17 bp, Artificial Sequence
  Synthetic Polynucleotide
aactcttcggtgcctga

SEQ ID NO: 5822 - DNA, 20 bp, Artificial Sequence
  Synthetic Polynucleotide
ctgttcagtgggttcaaaat

SEQ ID NO: 5823 - DNA, 18 bp, Artificial Sequence
  Synthetic Polynucleotide
tccagaattacggcttac

SEQ ID NO: 5824 - DNA, 20 bp, Artificial Sequence
  Synthetic Polynucleotide
aacaatatcctcaatgtacg

SEQ ID NO: 5825 - DNA, 20 bp, Artificial Sequence
  Synthetic Polynucleotide
tcttgttctgctgatacttg

SEQ ID NO: 5826 - DNA, 19 bp, Artificial Sequence
  Synthetic Polynucleotide
actggctgtcgcacatgaa

SEQ ID NO: 5827 - DNA, 18 bp, Artificial Sequence
  Synthetic Polynucleotide
cgacatactcggggaagt

SEQ ID NO: 5828 - DNA, 20 bp, Artificial Sequence
  Synthetic Polynucleotide
tatccaactatcatccacat

SEQ ID NO: 5829 - DNA, 18 bp, Artificial Sequence
  Synthetic Polynucleotide
tcaagacactctgctcaa

SEQ ID NO: 5830 - DNA, 17 bp, Artificial Sequence
  Synthetic Polynucleotide
catacgttacaaggtgc

SEQ ID NO: 5831 - DNA, 18 bp, Artificial Sequence
  Synthetic Polynucleotide
gtatggggtagggtttta

SEQ ID NO: 5832 - DNA, 19 bp, Artificial Sequence
  Synthetic Polynucleotide
tcgctaggctattttgtgt

SEQ ID NO: 5833 - DNA, 18 bp, Artificial Sequence
  Synthetic Polynucleotide
cctcttggcaatacttct

SEQ ID NO: 5834 - DNA, 20 bp, Artificial Sequence
  Synthetic Polynucleotide
ttctcttcttctactttggg

SEQ ID NO: 5835 - DNA, 17 bp, Artificial Sequence
  Synthetic Polynucleotide
ccaaggtttgctctgtt

SEQ ID NO: 5836 - DNA, 19 bp, Artificial Sequence
  Synthetic Polynucleotide
taacctctatgggtatctg

SEQ ID NO: 5837 - DNA, 18 bp, Artificial Sequence
  Synthetic Polynucleotide
ctcgtaggggctgctgat

SEQ ID NO: 5838 - DNA, 17 bp, Artificial Sequence
  Synthetic Polynucleotide
ctcgtccagttcctcac

SEQ ID NO: 5839 - DNA, 20 bp, Artificial Sequence
  Synthetic Polynucleotide
caatgtcaatcatttcgtca

SEQ ID NO: 5840 - DNA, 19 bp, Artificial Sequence
  Synthetic Polynucleotide
tgggttaaagacatggcaa

SEQ ID NO: 5841 - DNA, 19 bp, Artificial Sequence
  Synthetic Polynucleotide
gttaaacagacgacgaacg

SEQ ID NO: 5842 - DNA, 17 bp, Artificial Sequence
  Synthetic Polynucleotide
ctgctgatattgctggt

SEQ ID NO: 5843 - DNA, 20 bp, Artificial Sequence
  Synthetic Polynucleotide
atgctcgtgatattcatcaa

SEQ ID NO: 5844 - DNA, 17 bp, Artificial Sequence
  Synthetic Polynucleotide
acagagaaacaggcgtg

SEQ ID NO: 5845 - DNA, 17 bp, Artificial Sequence
  Synthetic Polynucleotide
gcaggcattgttggcgt

SEQ ID NO: 5846 - DNA, 17 bp, Artificial Sequence
  Synthetic Polynucleotide
ttcaggaaaccgaacgt

SEQ ID NO: 5847 - DNA, 20 bp, Artificial Sequence
  Synthetic Polynucleotide
tcagatagactgtgggtatc

SEQ ID NO: 5848 - DNA, 20 bp, Artificial Sequence
  Synthetic Polynucleotide
acgaaaggggatagctactc

SEQ ID NO: 5849 - DNA, 17 bp, Artificial Sequence
  Synthetic Polynucleotide
acagtggtcgcagtaca

SEQ ID NO: 5850 - DNA, 20 bp, Artificial Sequence
  Synthetic Polynucleotide
ctctacctggagatggtccg

SEQ ID NO: 5851 - DNA, 19 bp, Artificial Sequence
  Synthetic Polynucleotide
agagaacagggtggttagc

SEQ ID NO: 5852 - DNA, 18 bp, Artificial Sequence
  Synthetic Polynucleotide
tgtagtcacttacatgga

SEQ ID NO: 5853 - DNA, 18 bp, Artificial Sequence
  Synthetic Polynucleotide
ttggggcatatatagtcc

SEQ ID NO: 5854 - DNA, 19 bp, Artificial Sequence
  Synthetic Polynucleotide
ctggaagaaaatcgctgag

SEQ ID NO: 5855 - DNA, 20 bp, Artificial Sequence
  Synthetic Polynucleotide
cacttggaagggatgcaatt

SEQ ID NO: 5856 - DNA, 18 bp, Artificial Sequence
  Synthetic Polynucleotide
ttgaatgttggggtgcta

SEQ ID NO: 5857 - DNA, 19 bp, Artificial Sequence
  Synthetic Polynucleotide
cgctgattaccgtaccgtg

SEQ ID NO: 5858 - DNA, 20 bp, Artificial Sequence
  Synthetic Polynucleotide
cgtaccgaaaaggttcccgt

SEQ ID NO: 5859 - DNA, 18 bp, Artificial Sequence
  Synthetic Polynucleotide
ttgctcaaaatgtccgtc

SEQ ID NO: 5860 - DNA, 19 bp, Artificial Sequence
  Synthetic Polynucleotide
cctcataagggtgtggttt

SEQ ID NO: 5861 - DNA, 17 bp, Artificial Sequence
  Synthetic Polynucleotide
tgaggccgtagaagcta

SEQ ID NO: 5862 - DNA, 19 bp, Artificial Sequence
  Synthetic Polynucleotide
ctgtccgattagtgtatcc

SEQ ID NO: 5863 - DNA, 18 bp, Artificial Sequence
  Synthetic Polynucleotide
cgatgtgaaggtattcca

SEQ ID NO: 5864 - DNA, 17 bp, Artificial Sequence
  Synthetic Polynucleotide
gaccgaggagaaagacg

SEQ ID NO: 5865 - DNA, 18 bp, Artificial Sequence
  Synthetic Polynucleotide
ggtcgaagttacatggag

SEQ ID NO: 5866 - DNA, 20 bp, Artificial Sequence
  Synthetic Polynucleotide
ttcgaaggtgatgatcgttt

SEQ ID NO: 5867 - DNA, 19 bp, Artificial Sequence
  Synthetic Polynucleotide
cctcaatcaatgggattcc

SEQ ID NO: 5868 - DNA, 17 bp, Artificial Sequence
  Synthetic Polynucleotide
tcagatggtgctgtacg

SEQ ID NO: 5869 - DNA, 20 bp, Artificial Sequence
  Synthetic Polynucleotide
ggagaaaacagaaaggtgaa

SEQ ID NO: 5870 - DNA, 20 bp, Artificial Sequence
  Synthetic Polynucleotide
ccaaagagatttatcgaagt

SEQ ID NO: 5871 - DNA, 17 bp, Artificial Sequence
  Synthetic Polynucleotide
acccgttttcagttgag

SEQ ID NO: 5872 - DNA, 17 bp, Artificial Sequence
  Synthetic Polynucleotide
gcggctatgatgccatg

SEQ ID NO: 5873 - DNA, 20 bp, Artificial Sequence
  Synthetic Polynucleotide
gttttaccaacattttgagc

SEQ ID NO: 5874 - DNA, 19 bp, Artificial Sequence
  Synthetic Polynucleotide
aaggacgtttgcgatgcaa

SEQ ID NO: 5875 - DNA, 20 bp, Artificial Sequence
  Synthetic Polynucleotide
ggaacaggtgattctcagct

SEQ ID NO: 5876 - DNA, 17 bp, Artificial Sequence
  Synthetic Polynucleotide
tcagtaaccaacgccaa

SEQ ID NO: 5877 - DNA, 20 bp, Artificial Sequence
  Synthetic Polynucleotide
gacagcatcttactttactt

SEQ ID NO: 5878 - DNA, 17 bp, Artificial Sequence
  Synthetic Polynucleotide
tgtgattcgtgaagcga

SEQ ID NO: 5879 - DNA, 19 bp, Artificial Sequence
  Synthetic Polynucleotide
gtcagattcgttcagctta

SEQ ID NO: 5880 - DNA, 17 bp, Artificial Sequence
  Synthetic Polynucleotide
ccgggatcagagacatt

SEQ ID NO: 5881 - DNA, 18 bp, Artificial Sequence
  Synthetic Polynucleotide
tcccttctccaccttgtg

SEQ ID NO: 5882 - DNA, 17 bp, Artificial Sequence
  Synthetic Polynucleotide
cggggcttagtattacc

SEQ ID NO: 5883 - DNA, 19 bp, Artificial Sequence
  Synthetic Polynucleotide
tagttcatcatctccgaag

SEQ ID NO: 5884 - DNA, 18 bp, Artificial Sequence
  Synthetic Polynucleotide
cccgaagaaatgcaattg

SEQ ID NO: 5885 - DNA, 18 bp, Artificial Sequence
  Synthetic Polynucleotide
tattcgttacctttgctt

SEQ ID NO: 5886 - DNA, 18 bp, Artificial Sequence
  Synthetic Polynucleotide
gcggggcttagtattacc

SEQ ID NO: 5887 - DNA, 20 bp, Artificial Sequence
  Synthetic Polynucleotide
ccaccaaccttccttcaagg

SEQ ID NO: 5888 - DNA, 19 bp, Artificial Sequence
  Synthetic Polynucleotide
atgaattgttgaagacgat

SEQ ID NO: 5889 - DNA, 18 bp, Artificial Sequence
  Synthetic Polynucleotide
atttcatagcgtgttgta

SEQ ID NO: 5890 - DNA, 17 bp, Artificial Sequence
  Synthetic Polynucleotide
cgctggggcttattatt

SEQ ID NO: 5891 - DNA, 19 bp, Artificial Sequence
  Synthetic Polynucleotide
atccatatcctccgaatgg

SEQ ID NO: 5892 - DNA, 18 bp, Artificial Sequence
  Synthetic Polynucleotide
ctgtgtttaacggaagct

SEQ ID NO: 5893 - DNA, 19 bp, Artificial Sequence
  Synthetic Polynucleotide
gttgcctccatagaaactg

SEQ ID NO: 5894 - DNA, 19 bp, Artificial Sequence
  Synthetic Polynucleotide
gctcacactgcaactaaca

SEQ ID NO: 5895 - DNA, 17 bp, Artificial Sequence
  Synthetic Polynucleotide
gatgtgggacttctctc

SEQ ID NO: 5896 - DNA, 19 bp, Artificial Sequence
  Synthetic Polynucleotide
taatcatcctgttcatgta

SEQ ID NO: 5897 - DNA, 19 bp, Artificial Sequence
  Synthetic Polynucleotide
ccaatgattttcctcctgg

SEQ ID NO: 5898 - DNA, 18 bp, Artificial Sequence
  Synthetic Polynucleotide
ggggcttattattacccc

SEQ ID NO: 5899 - DNA, 18 bp, Artificial Sequence
  Synthetic Polynucleotide
gctcagttctccaaccta

SEQ ID NO: 5900 - DNA, 18 bp, Artificial Sequence
  Synthetic Polynucleotide
gtgcaatccacttgttgg

SEQ ID NO: 5901 - DNA, 19 bp, Artificial Sequence
  Synthetic Polynucleotide
atttcgttttgggtcctcg

SEQ ID NO: 5902 - DNA, 18 bp, Artificial Sequence
  Synthetic Polynucleotide
tagagactactgttcgaa

SEQ ID NO: 5903 - DNA, 20 bp, Artificial Sequence
  Synthetic Polynucleotide
ttcatagcgtgttgtatgtt

SEQ ID NO: 5904 - DNA, 18 bp, Artificial Sequence
  Synthetic Polynucleotide
gggttttgggctcatggg

SEQ ID NO: 5905 - DNA, 17 bp, Artificial Sequence
  Synthetic Polynucleotide
cttgggttttacctcca

SEQ ID NO: 5906 - DNA, 17 bp, Artificial Sequence
  Synthetic Polynucleotide
tatttgggtctacggcc

SEQ ID NO: 5907 - DNA, 19 bp, Artificial Sequence
  Synthetic Polynucleotide
aactccaattcgcaatagg

SEQ ID NO: 5908 - DNA, 20 bp, Artificial Sequence
  Synthetic Polynucleotide
cttcgtctaaggttgtaagt

SEQ ID NO: 5909 - DNA, 19 bp, Artificial Sequence
  Synthetic Polynucleotide
ccatacacccaaagaatac

SEQ ID NO: 5910 - DNA, 20 bp, Artificial Sequence
  Synthetic Polynucleotide
agaagaaacaagagttgcag

SEQ ID NO: 5911 - DNA, 20 bp, Artificial Sequence
  Synthetic Polynucleotide
tctctctaacgctgtcttat

SEQ ID NO: 5912 - DNA, 19 bp, Artificial Sequence
  Synthetic Polynucleotide
gtattaccccgcctcgtta

SEQ ID NO: 5913 - DNA, 18 bp, Artificial Sequence
  Synthetic Polynucleotide
tatctgctgacaatcact

SEQ ID NO: 5914 - DNA, 18 bp, Artificial Sequence
  Synthetic Polynucleotide
ttccgaaatcactcgtcg

SEQ ID NO: 5915 - DNA, 20 bp, Artificial Sequence
  Synthetic Polynucleotide
ttatacacacccaaaggata

SEQ ID NO: 5916 - DNA, 17 bp, Artificial Sequence
  Synthetic Polynucleotide
gacccgcacatgcctaa

SEQ ID NO: 5917 - DNA, 19 bp, Artificial Sequence
  Synthetic Polynucleotide
ctaagcgtagtttccccac

SEQ ID NO: 5918 - DNA, 19 bp, Artificial Sequence
  Synthetic Polynucleotide
attgggctactcttcttgt

SEQ ID NO: 5919 - DNA, 17 bp, Artificial Sequence
  Synthetic Polynucleotide
aatggctttcctgtgga

SEQ ID NO: 5920 - DNA, 17 bp, Artificial Sequence
  Synthetic Polynucleotide
ggttttgcacaatcgat

SEQ ID NO: 5921 - DNA, 17 bp, Artificial Sequence
  Synthetic Polynucleotide
attataccgtgcctgag

SEQ ID NO: 5922 - DNA, 19 bp, Artificial Sequence
  Synthetic Polynucleotide
ggttactgtgtaccgtttt

SEQ ID NO: 5923 - DNA, 19 bp, Artificial Sequence
  Synthetic Polynucleotide
gaatatgacattggactcg

SEQ ID NO: 5924 - DNA, 20 bp, Artificial Sequence
  Synthetic Polynucleotide
tgataatcctagagcattgt

SEQ ID NO: 5925 - DNA, 20 bp, Artificial Sequence
  Synthetic Polynucleotide
accagctccgatagaaaatg

SEQ ID NO: 5926 - DNA, 19 bp, Artificial Sequence
  Synthetic Polynucleotide
caaggctttctgacttatg

SEQ ID NO: 5927 - DNA, 18 bp, Artificial Sequence
  Synthetic Polynucleotide
atttcacccttcaacagt

SEQ ID NO: 5928 - DNA, 20 bp, Artificial Sequence
  Synthetic Polynucleotide
gaccatctacactgactgca

SEQ ID NO: 5929 - DNA, 19 bp, Artificial Sequence
  Synthetic Polynucleotide
aacgaagttctttacgaac

SEQ ID NO: 5930 - DNA, 19 bp, Artificial Sequence
  Synthetic Polynucleotide
tcttctgcaactgatagat

SEQ ID NO: 5931 - DNA, 20 bp, Artificial Sequence
  Synthetic Polynucleotide
tatgaactgtacttacgatt

SEQ ID NO: 5932 - DNA, 19 bp, Artificial Sequence
  Synthetic Polynucleotide
cccatttgttacctatgac

SEQ ID NO: 5933 - DNA, 20 bp, Artificial Sequence
  Synthetic Polynucleotide
gaaggtgaaccaaaatccct

SEQ ID NO: 5934 - DNA, 19 bp, Artificial Sequence
  Synthetic Polynucleotide
atcccggcaaacgaaatta

SEQ ID NO: 5935 - DNA, 17 bp, Artificial Sequence
  Synthetic Polynucleotide
gccgaagcgtaggacag

SEQ ID NO: 5936 - DNA, 17 bp, Artificial Sequence
  Synthetic Polynucleotide
aagttccactgagctgg

SEQ ID NO: 5937 - DNA, 18 bp, Artificial Sequence
  Synthetic Polynucleotide
gctaacggtaacccaaca

SEQ ID NO: 5938 - DNA, 18 bp, Artificial Sequence
  Synthetic Polynucleotide
cgacaaagcacccaagga

SEQ ID NO: 5939 - DNA, 17 bp, Artificial Sequence
  Synthetic Polynucleotide
attgccccatagcccca

SEQ ID NO: 5940 - DNA, 18 bp, Artificial Sequence
  Synthetic Polynucleotide
cttggagaacaccagatc

SEQ ID NO: 5941 - DNA, 17 bp, Artificial Sequence
  Synthetic Polynucleotide
cgctagaacaccatcta

SEQ ID NO: 5942 - DNA, 19 bp, Artificial Sequence
  Synthetic Polynucleotide
ccaagttccaaaatggtta

SEQ ID NO: 5943 - DNA, 18 bp, Artificial Sequence
  Synthetic Polynucleotide
gtcattaccctctcgacc

SEQ ID NO: 5944 - DNA, 17 bp, Artificial Sequence
  Synthetic Polynucleotide
agccgcagattagcttc

SEQ ID NO: 5945 - DNA, 19 bp, Artificial Sequence
  Synthetic Polynucleotide
acgaaacctgtattatccg

SEQ ID NO: 5946 - DNA, 20 bp, Artificial Sequence
  Synthetic Polynucleotide
gccttataatgtgtcaatga

SEQ ID NO: 5947 - DNA, 18 bp, Artificial Sequence
  Synthetic Polynucleotide
atcagtaccacctccggg

SEQ ID NO: 5948 - DNA, 17 bp, Artificial Sequence
  Synthetic Polynucleotide
tcgtcagtcgcagtacc

SEQ ID NO: 5949 - DNA, 18 bp, Artificial Sequence
  Synthetic Polynucleotide
aatcaaacccacaaggaa

SEQ ID NO: 5950 - DNA, 20 bp, Artificial Sequence
  Synthetic Polynucleotide
tagagtatcgtccgaatcca

SEQ ID NO: 5951 - DNA, 17 bp, Artificial Sequence
  Synthetic Polynucleotide
tttgaggaccatcccca

SEQ ID NO: 5952 - DNA, 19 bp, Artificial Sequence
  Synthetic Polynucleotide
gcagatccacaaagttcac

SEQ ID NO: 5953 - DNA, 17 bp, Artificial Sequence
  Synthetic Polynucleotide
aaccgcaccctgataat

SEQ ID NO: 5954 - DNA, 20 bp, Artificial Sequence
  Synthetic Polynucleotide
ttccatgccacaaattaatc

SEQ ID NO: 5955 - DNA, 18 bp, Artificial Sequence
  Synthetic Polynucleotide
ggttcagatagcatcatg

SEQ ID NO: 5956 - DNA, 19 bp, Artificial Sequence
  Synthetic Polynucleotide
cgacaacaacgtcccaaag

SEQ ID NO: 5957 - DNA, 18 bp, Artificial Sequence
  Synthetic Polynucleotide
ccccaacaaatgccatta

SEQ ID NO: 5958 - DNA, 18 bp, Artificial Sequence
  Synthetic Polynucleotide
ttcaggatggtgatatgg

SEQ ID NO: 5959 - DNA, 17 bp, Artificial Sequence
  Synthetic Polynucleotide
gcatttccagtttgcat

SEQ ID NO: 5960 - DNA, 20 bp, Artificial Sequence
  Synthetic Polynucleotide
tgcaggccctaaaacgaaag

SEQ ID NO: 5961 - DNA, 17 bp, Artificial Sequence
  Synthetic Polynucleotide
ttccagctttggtcagt

SEQ ID NO: 5962 - DNA, 17 bp, Artificial Sequence
  Synthetic Polynucleotide
cctgaggtggaggtacc

SEQ ID NO: 5963 - DNA, 19 bp, Artificial Sequence
  Synthetic Polynucleotide
tctagatagtaagtgccat

SEQ ID NO: 5964 - DNA, 18 bp, Artificial Sequence
  Synthetic Polynucleotide
aagtgcttaaggtatcgc

SEQ ID NO: 5965 - DNA, 19 bp, Artificial Sequence
  Synthetic Polynucleotide
gttctaacaactgttcctg

SEQ ID NO: 5966 - DNA, 17 bp, Artificial Sequence
  Synthetic Polynucleotide
ggctattctgaagtgga

SEQ ID NO: 5967 - DNA, 19 bp, Artificial Sequence
  Synthetic Polynucleotide
acattgtcatgtatcccac

SEQ ID NO: 5968 - DNA, 18 bp, Artificial Sequence
  Synthetic Polynucleotide
gacatggtccagattaga

SEQ ID NO: 5969 - DNA, 17 bp, Artificial Sequence
  Synthetic Polynucleotide
caccaggtaaaaggtca

SEQ ID NO: 5970 - DNA, 17 bp, Artificial Sequence
  Synthetic Polynucleotide
aagaagacgagggagag

SEQ ID NO: 5971 - DNA, 19 bp, Artificial Sequence
  Synthetic Polynucleotide
ttgccaatcctctaaaata

SEQ ID NO: 5972 - DNA, 19 bp, Artificial Sequence
  Synthetic Polynucleotide
tagtcttagaaagcgtcgt

SEQ ID NO: 5973 - DNA, 18 bp, Artificial Sequence
  Synthetic Polynucleotide
tcctgtaatgtccacggt

SEQ ID NO: 5974 - DNA, 19 bp, Artificial Sequence
  Synthetic Polynucleotide
gtttagatgtgtgccagga

SEQ ID NO: 5975 - DNA, 20 bp, Artificial Sequence
  Synthetic Polynucleotide
tgtctgaggtaggttctgta

SEQ ID NO: 5976 - DNA, 19 bp, Artificial Sequence
  Synthetic Polynucleotide
taagtcaggagttccaatt

SEQ ID NO: 5977 - DNA, 19 bp, Artificial Sequence
  Synthetic Polynucleotide
aggtttcccaggtatatga

SEQ ID NO: 5978 - DNA, 18 bp, Artificial Sequence
  Synthetic Polynucleotide
agatgatgctgccaggta

SEQ ID NO: 5979 - DNA, 17 bp, Artificial Sequence
  Synthetic Polynucleotide
cggcccgaactttagac

SEQ ID NO: 5980 - DNA, 19 bp, Artificial Sequence
  Synthetic Polynucleotide
aacaaagtgtccgccgttg

SEQ ID NO: 5981 - DNA, 20 bp, Artificial Sequence
  Synthetic Polynucleotide
acaagcccataaaccccagt

SEQ ID NO: 5982 - DNA, 18 bp, Artificial Sequence
  Synthetic Polynucleotide
gcactacaaaacgaaagt

SEQ ID NO: 5983 - DNA, 20 bp, Artificial Sequence
  Synthetic Polynucleotide
cactaggtgtccccataaat

SEQ ID NO: 5984 - DNA, 18 bp, Artificial Sequence
  Synthetic Polynucleotide
cgtgcaattagccagtcc

SEQ ID NO: 5985 - DNA, 20 bp, Artificial Sequence
  Synthetic Polynucleotide
gattaggtgtgtcttggtgg

SEQ ID NO: 5986 - DNA, 18 bp, Artificial Sequence
  Synthetic Polynucleotide
ctgttcctgtgagtaagt

SEQ ID NO: 5987 - DNA, 17 bp, Artificial Sequence
  Synthetic Polynucleotide
ccagtgttccccaatag

SEQ ID NO: 5988 - DNA, 17 bp, Artificial Sequence
  Synthetic Polynucleotide
cagatggctttgtggcg

SEQ ID NO: 5989 - DNA, 19 bp, Artificial Sequence
  Synthetic Polynucleotide
ggtatccagacactttggg

SEQ ID NO: 5990 - DNA, 20 bp, Artificial Sequence
  Synthetic Polynucleotide
cctactgttgtggatgtagg

SEQ ID NO: 5991 - DNA, 19 bp, Artificial Sequence
  Synthetic Polynucleotide
ctgtatcaatcatatcgcc

SEQ ID NO: 5992 - DNA, 18 bp, Artificial Sequence
  Synthetic Polynucleotide
ttattgaacctgtgggtc

SEQ ID NO: 5993 - DNA, 19 bp, Artificial Sequence
  Synthetic Polynucleotide
catttctgaggtatgtgtc

SEQ ID NO: 5994 - DNA, 17 bp, Artificial Sequence
  Synthetic Polynucleotide
gactgtgcaactatggt

SEQ ID NO: 5995 - DNA, 19 bp, Artificial Sequence
  Synthetic Polynucleotide
atctgactttgtggcattt

SEQ ID NO: 5996 - DNA, 19 bp, Artificial Sequence
  Synthetic Polynucleotide
cagacgagattgctgctgc

SEQ ID NO: 5997 - DNA, 20 bp, Artificial Sequence
  Synthetic Polynucleotide
gtcttcttggtcacttagat

SEQ ID NO: 5998 - DNA, 17 bp, Artificial Sequence
  Synthetic Polynucleotide
acctgcattgtgacgaa

SEQ ID NO: 5999 - DNA, 18 bp, Artificial Sequence
  Synthetic Polynucleotide
ctgtgtttgttttgggtc

SEQ ID NO: 6000 - DNA, 17 bp, Artificial Sequence
  Synthetic Polynucleotide
atttgaaaatcccgcct

SEQ ID NO: 6001 - DNA, 19 bp, Artificial Sequence
  Synthetic Polynucleotide
ggatcagtacctttatcgt

SEQ ID NO: 6002 - DNA, 17 bp, Artificial Sequence
  Synthetic Polynucleotide
ccagcccattgacctgc

SEQ ID NO: 6003 - DNA, 17 bp, Artificial Sequence
  Synthetic Polynucleotide
gggtttgttttgcatca

SEQ ID NO: 6004 - DNA, 17 bp, Artificial Sequence
  Synthetic Polynucleotide
tcagttcagggtgttta

SEQ ID NO: 6005 - DNA, 19 bp, Artificial Sequence
  Synthetic Polynucleotide
atggactgcctaaatactt

SEQ ID NO: 6006 - DNA, 18 bp, Artificial Sequence
  Synthetic Polynucleotide
ggatgaggatgaggatga

SEQ ID NO: 6007 - DNA, 19 bp, Artificial Sequence
  Synthetic Polynucleotide
tgagccttttgtatccagt

SEQ ID NO: 6008 - DNA, 18 bp, Artificial Sequence
  Synthetic Polynucleotide
tatgtgtgatattggctt

SEQ ID NO: 6009 - DNA, 19 bp, Artificial Sequence
  Synthetic Polynucleotide
aggtttatcagtttgtggt

SEQ ID NO: 6010 - DNA, 20 bp, Artificial Sequence
  Synthetic Polynucleotide
tttgaatttgaaaatcccgc

SEQ ID NO: 6011 - DNA, 19 bp, Artificial Sequence
  Synthetic Polynucleotide
tcgtggcatcatattgagc

SEQ ID NO: 6012 - DNA, 17 bp, Artificial Sequence
  Synthetic Polynucleotide
agcccattgtaccattt

SEQ ID NO: 6013 - DNA, 20 bp, Artificial Sequence
  Synthetic Polynucleotide
aaaagttagctgttgtttct

SEQ ID NO: 6014 - DNA, 19 bp, Artificial Sequence
  Synthetic Polynucleotide
ccttgttcttattgtgcct

SEQ ID NO: 6015 - DNA, 17 bp, Artificial Sequence
  Synthetic Polynucleotide
acatttgaaaatcccgc

SEQ ID NO: 6016 - DNA, 20 bp, Artificial Sequence
  Synthetic Polynucleotide
tagtcatgttctctgttcct

SEQ ID NO: 6017 - DNA, 18 bp, Artificial Sequence
  Synthetic Polynucleotide
gttgttttgctctcttcc

SEQ ID NO: 6018 - DNA, 18 bp, Artificial Sequence
  Synthetic Polynucleotide
aaatgccttccagttttc

SEQ ID NO: 6019 - DNA, 17 bp, Artificial Sequence
  Synthetic Polynucleotide
gcaatgcacaagcaaaa

SEQ ID NO: 6020 - DNA, 20 bp, Artificial Sequence
  Synthetic Polynucleotide
agtcaggtcaatgttccaga

SEQ ID NO: 6021 - DNA, 18 bp, Artificial Sequence
  Synthetic Polynucleotide
gcaggaaaacaagtcaga

SEQ ID NO: 6022 - DNA, 17 bp, Artificial Sequence
  Synthetic Polynucleotide
cagtgtcttgtcgctac

SEQ ID NO: 6023 - DNA, 19 bp, Artificial Sequence
  Synthetic Polynucleotide
ggtatctagtgatgctcaa

SEQ ID NO: 6024 - DNA, 20 bp, Artificial Sequence
  Synthetic Polynucleotide
tgaaaccagagtagggtgat

SEQ ID NO: 6025 - DNA, 17 bp, Artificial Sequence
  Synthetic Polynucleotide
aatacctcggccttacg

SEQ ID NO: 6026 - DNA, 17 bp, Artificial Sequence
  Synthetic Polynucleotide
gggcaggaaatggtcaa

SEQ ID NO: 6027 - DNA, 17 bp, Artificial Sequence
  Synthetic Polynucleotide
tacagggtgtttcgcat

SEQ ID NO: 6028 - DNA, 18 bp, Artificial Sequence
  Synthetic Polynucleotide
cggtctgtcggttcttgt

SEQ ID NO: 6029 - DNA, 17 bp, Artificial Sequence
  Synthetic Polynucleotide
cagttcatgtgtttgga

SEQ ID NO: 6030 - DNA, 20 bp, Artificial Sequence
  Synthetic Polynucleotide
ggaggtccccatataactat

SEQ ID NO: 6031 - DNA, 19 bp, Artificial Sequence
  Synthetic Polynucleotide
cgatttatctcagatggtc

SEQ ID NO: 6032 - DNA, 20 bp, Artificial Sequence
  Synthetic Polynucleotide
ctaattgtctccaaagcctt

SEQ ID NO: 6033 - DNA, 20 bp, Artificial Sequence
  Synthetic Polynucleotide
gtctgaagccaaaatagctt

SEQ ID NO: 6034 - DNA, 19 bp, Artificial Sequence
  Synthetic Polynucleotide
aagagatgatgtagtggct

SEQ ID NO: 6035 - DNA, 18 bp, Artificial Sequence
  Synthetic Polynucleotide
cgtgtttatatcgccatc

SEQ ID NO: 6036 - DNA, 17 bp, Artificial Sequence
  Synthetic Polynucleotide
gggtgtccagtatgaag

SEQ ID NO: 6037 - DNA, 20 bp, Artificial Sequence
  Synthetic Polynucleotide
tcagttgtatcgtgactgct

SEQ ID NO: 6038 - DNA, 18 bp, Artificial Sequence
  Synthetic Polynucleotide
tgttacagggtctgtggg

SEQ ID NO: 6039 - DNA, 18 bp, Artificial Sequence
  Synthetic Polynucleotide
tagggtagggtgtagtag

SEQ ID NO: 6040 - DNA, 18 bp, Artificial Sequence
  Synthetic Polynucleotide
ccatgtgtgtcctcttcc

SEQ ID NO: 6041 - DNA, 19 bp, Artificial Sequence
  Synthetic Polynucleotide
caaattgggtagtagtgtg

SEQ ID NO: 6042 - DNA, 20 bp, Artificial Sequence
  Synthetic Polynucleotide
gtcttgtagtgtctaaccat

SEQ ID NO: 6043 - DNA, 20 bp, Artificial Sequence
  Synthetic Polynucleotide
tgggatacggaatctacagg

SEQ ID NO: 6044 - DNA, 18 bp, Artificial Sequence
  Synthetic Polynucleotide
tcctcttcctcgtcggaa

SEQ ID NO: 6045 - DNA, 20 bp, Artificial Sequence
  Synthetic Polynucleotide
ggatggaaaagtaaagactt

SEQ ID NO: 6046 - DNA, 20 bp, Artificial Sequence
  Synthetic Polynucleotide
ggaataggtagaagttggtg

SEQ ID NO: 6047 - DNA, 17 bp, Artificial Sequence
  Synthetic Polynucleotide
gcgtttcattgtaggac

SEQ ID NO: 6048 - DNA, 17 bp, Artificial Sequence
  Synthetic Polynucleotide
ggatcagcagtttctgt

SEQ ID NO: 6049 - DNA, 20 bp, Artificial Sequence
  Synthetic Polynucleotide
tttaatcaggacattgcaga

SEQ ID NO: 6050 - DNA, 20 bp, Artificial Sequence
  Synthetic Polynucleotide
gctatgaagcaacgaataca

SEQ ID NO: 6051 - DNA, 18 bp, Artificial Sequence
  Synthetic Polynucleotide
accgacgcagctatccgt

SEQ ID NO: 6052 - DNA, 18 bp, Artificial Sequence
  Synthetic Polynucleotide
tacaaagagggttggatt

SEQ ID NO: 6053 - DNA, 19 bp, Artificial Sequence
  Synthetic Polynucleotide
gtgtcagtgcccaaggttt

SEQ ID NO: 6054 - DNA, 17 bp, Artificial Sequence
  Synthetic Polynucleotide
gttgcactcacactgca

SEQ ID NO: 6055 - DNA, 17 bp, Artificial Sequence
  Synthetic Polynucleotide
aatatgcgtgccaccta

SEQ ID NO: 6056 - DNA, 17 bp, Artificial Sequence
  Synthetic Polynucleotide
gccatcccattgtcctt

SEQ ID NO: 6057 - DNA, 18 bp, Artificial Sequence
  Synthetic Polynucleotide
tgctttatgcctcttagc

SEQ ID NO: 6058 - DNA, 20 bp, Artificial Sequence
  Synthetic Polynucleotide
cttgattcattactcccaca

SEQ ID NO: 6059 - DNA, 19 bp, Artificial Sequence
  Synthetic Polynucleotide
atataccaacctgaccatc

SEQ ID NO: 6060 - DNA, 20 bp, Artificial Sequence
  Synthetic Polynucleotide
gactggattacaccaagact

SEQ ID NO: 6061 - DNA, 20 bp, Artificial Sequence
  Synthetic Polynucleotide
aagaagattctgaagttgag

SEQ ID NO: 6062 - DNA, 20 bp, Artificial Sequence
  Synthetic Polynucleotide
tcatcttgagcatgatattt

SEQ ID NO: 6063 - DNA, 18 bp, Artificial Sequence
  Synthetic Polynucleotide
ccattcctgctacagatg

SEQ ID NO: 6064 - DNA, 19 bp, Artificial Sequence
  Synthetic Polynucleotide
caccactcttcgacccagg

SEQ ID NO: 6065 - DNA, 17 bp, Artificial Sequence
  Synthetic Polynucleotide
tcaagccctgagagagg

SEQ ID NO: 6066 - DNA, 19 bp, Artificial Sequence
  Synthetic Polynucleotide
gcattgaaaacactccctg

SEQ ID NO: 6067 - DNA, 18 bp, Artificial Sequence
  Synthetic Polynucleotide
attacgatgatgagctgt

SEQ ID NO: 6068 - DNA, 18 bp, Artificial Sequence
  Synthetic Polynucleotide
gacattttgacttgtccc

SEQ ID NO: 6069 - DNA, 20 bp, Artificial Sequence
  Synthetic Polynucleotide
acaagtgaaaatgtctcttc

SEQ ID NO: 6070 - DNA, 20 bp, Artificial Sequence
  Synthetic Polynucleotide
ttcaataaagaagaccatga

SEQ ID NO: 6071 - DNA, 20 bp, Artificial Sequence
  Synthetic Polynucleotide
gttacaacaagagttcctag

SEQ ID NO: 6072 - DNA, 20 bp, Artificial Sequence
  Synthetic Polynucleotide
tccatatttcctatccatgt

SEQ ID NO: 6073 - DNA, 20 bp, Artificial Sequence
  Synthetic Polynucleotide
ggtcctaatactgctagtca

SEQ ID NO: 6074 - DNA, 19 bp, Artificial Sequence
  Synthetic Polynucleotide
ggtacatctctaccaagta

SEQ ID NO: 6075 - DNA, 20 bp, Artificial Sequence
  Synthetic Polynucleotide
cactcatgtcaccaaatata

SEQ ID NO: 6076 - DNA, 19 bp, Artificial Sequence
  Synthetic Polynucleotide
catcacatctttccatgtt

SEQ ID NO: 6077 - DNA, 18 bp, Artificial Sequence
  Synthetic Polynucleotide
atgctacactgatcctta

SEQ ID NO: 6078 - DNA, 18 bp, Artificial Sequence
  Synthetic Polynucleotide
ctttgccatcccattgtc

SEQ ID NO: 6079 - DNA, 19 bp, Artificial Sequence
  Synthetic Polynucleotide
tatcccaaacataaccatg

SEQ ID NO: 6080 - DNA, 20 bp, Artificial Sequence
  Synthetic Polynucleotide
tacctgaatgatctacaatc

SEQ ID NO: 6081 - DNA, 19 bp, Artificial Sequence
  Synthetic Polynucleotide
cactgtctaacattgtagg

SEQ ID NO: 6082 - DNA, 20 bp, Artificial Sequence
  Synthetic Polynucleotide
tcgataaacctttcatactc

SEQ ID NO: 6083 - DNA, 17 bp, Artificial Sequence
  Synthetic Polynucleotide
cacacccaccccacaca

SEQ ID NO: 6084 - DNA, 20 bp, Artificial Sequence
  Synthetic Polynucleotide
atctcatctctgtcttgata

SEQ ID NO: 6085 - DNA, 19 bp, Artificial Sequence
  Synthetic Polynucleotide
gacctccttcattttgcaa

SEQ ID NO: 6086 - DNA, 17 bp, Artificial Sequence
  Synthetic Polynucleotide
tataacccgattgtcct

SEQ ID NO: 6087 - DNA, 18 bp, Artificial Sequence
  Synthetic Polynucleotide
caggcgatgatgtctatg

SEQ ID NO: 6088 - DNA, 19 bp, Artificial Sequence
  Synthetic Polynucleotide
caactgcaccctgttgttt

SEQ ID NO: 6089 - DNA, 18 bp, Artificial Sequence
  Synthetic Polynucleotide
cagtgtcctaatgcaggc

SEQ ID NO: 6090 - DNA, 18 bp, Artificial Sequence
  Synthetic Polynucleotide
ccctcaataccacccata

SEQ ID NO: 6091 - DNA, 19 bp, Artificial Sequence
  Synthetic Polynucleotide
aagttctgcttaaattgga

SEQ ID NO: 6092 - DNA, 17 bp, Artificial Sequence
  Synthetic Polynucleotide
gggtccatgatcttgat

SEQ ID NO: 6093 - DNA, 19 bp, Artificial Sequence
  Synthetic Polynucleotide
gtgcaacccaatatgtcac

SEQ ID NO: 6094 - DNA, 18 bp, Artificial Sequence
  Synthetic Polynucleotide
tgctcctccatgtctatc

SEQ ID NO: 6095 - DNA, 20 bp, Artificial Sequence
  Synthetic Polynucleotide
actttctcttcaaagttgga

SEQ ID NO: 6096 - DNA, 19 bp, Artificial Sequence
  Synthetic Polynucleotide
ttgtccaagtatcctgtta

SEQ ID NO: 6097 - DNA, 18 bp, Artificial Sequence
  Synthetic Polynucleotide
gcccctggaaactatcca

SEQ ID NO: 6098 - DNA, 19 bp, Artificial Sequence
  Synthetic Polynucleotide
atttcatttgcgtcgaaga

SEQ ID NO: 6099 - DNA, 18 bp, Artificial Sequence
  Synthetic Polynucleotide
tcggtgtgttttctggtc

SEQ ID NO: 6100 - DNA, 19 bp, Artificial Sequence
  Synthetic Polynucleotide
ccattctctgttttggatg

SEQ ID NO: 6101 - DNA, 20 bp, Artificial Sequence
  Synthetic Polynucleotide
tttaatggatctaaatccgc

SEQ ID NO: 6102 - DNA, 19 bp, Artificial Sequence
  Synthetic Polynucleotide
ccttgttggaatttctgat

SEQ ID NO: 6103 - DNA, 18 bp, Artificial Sequence
  Synthetic Polynucleotide
agcttcaaccctggaaaa

SEQ ID NO: 6104 - DNA, 17 bp, Artificial Sequence
  Synthetic Polynucleotide
cagacctaacctctccg

SEQ ID NO: 6105 - DNA, 20 bp, Artificial Sequence
  Synthetic Polynucleotide
ctttagtaagttgaccactt

SEQ ID NO: 6106 - DNA, 18 bp, Artificial Sequence
  Synthetic Polynucleotide
gtcacaaacctgtgagac

SEQ ID NO: 6107 - DNA, 17 bp, Artificial Sequence
  Synthetic Polynucleotide
tagcaaagttccttctg

SEQ ID NO: 6108 - DNA, 18 bp, Artificial Sequence
  Synthetic Polynucleotide
ttcgtctccgatgatctt

SEQ ID NO: 6109 - DNA, 19 bp, Artificial Sequence
  Synthetic Polynucleotide
aaattgatgccgaatgtaa

SEQ ID NO: 6110 - DNA, 18 bp, Artificial Sequence
  Synthetic Polynucleotide
agcttgaaccactcattc

SEQ ID NO: 6111 - DNA, 17 bp, Artificial Sequence
  Synthetic Polynucleotide
gcgcttgtataccgagt

SEQ ID NO: 6112 - DNA, 20 bp, Artificial Sequence
  Synthetic Polynucleotide
cctccttgtcgataaacgaa

SEQ ID NO: 6113 - DNA, 19 bp, Artificial Sequence
  Synthetic Polynucleotide
tccgctaggataccatctg

SEQ ID NO: 6114 - DNA, 19 bp, Artificial Sequence
  Synthetic Polynucleotide
gagtcgtcaccactacacg

SEQ ID NO: 6115 - DNA, 17 bp, Artificial Sequence
  Synthetic Polynucleotide
caacaaaccgtacatgc

SEQ ID NO: 6116 - DNA, 20 bp, Artificial Sequence
  Synthetic Polynucleotide
ttcttgacaatagcagtttt

SEQ ID NO: 6117 - DNA, 20 bp, Artificial Sequence
  Synthetic Polynucleotide
gccctgctcacatcttagat

SEQ ID NO: 6118 - DNA, 17 bp, Artificial Sequence
  Synthetic Polynucleotide
cctcatcttggttggat

SEQ ID NO: 6119 - DNA, 18 bp, Artificial Sequence
  Synthetic Polynucleotide
aagacatctggggtaaaa

SEQ ID NO: 6120 - DNA, 18 bp, Artificial Sequence
  Synthetic Polynucleotide
cctatccagtcaaaaggg

SEQ ID NO: 6121 - DNA, 18 bp, Artificial Sequence
  Synthetic Polynucleotide
ctgctctacctcaacttt

SEQ ID NO: 6122 - DNA, 20 bp, Artificial Sequence
  Synthetic Polynucleotide
agcaaatccgtctggggtaa

SEQ ID NO: 6123 - DNA, 19 bp, Artificial Sequence
  Synthetic Polynucleotide
ctatccctggaaactttca

SEQ ID NO: 6124 - DNA, 20 bp, Artificial Sequence
  Synthetic Polynucleotide
tcaattagaccatcgaaaat

SEQ ID NO: 6125 - DNA, 18 bp, Artificial Sequence
  Synthetic Polynucleotide
gacctgtctacgcaatgg

SEQ ID NO: 6126 - DNA, 19 bp, Artificial Sequence
  Synthetic Polynucleotide
ttctgtcatcaggaattgg

SEQ ID NO: 6127 - DNA, 19 bp, Artificial Sequence
  Synthetic Polynucleotide
tcactcctcgtcacaacat

SEQ ID NO: 6128 - DNA, 19 bp, Artificial Sequence
  Synthetic Polynucleotide
aaagttagctctgttagct

SEQ ID NO: 6129 - DNA, 18 bp, Artificial Sequence
  Synthetic Polynucleotide
tgcctttcgtcctcttca

SEQ ID NO: 6130 - DNA, 19 bp, Artificial Sequence
  Synthetic Polynucleotide
ttatctctgttcatgtcgt

SEQ ID NO: 6131 - DNA, 19 bp, Artificial Sequence
  Synthetic Polynucleotide
gaagccatttgtgctgtgc

SEQ ID NO: 6132 - DNA, 20 bp, Artificial Sequence
  Synthetic Polynucleotide
gatagccactcagtagtaga

SEQ ID NO: 6133 - DNA, 19 bp, Artificial Sequence
  Synthetic Polynucleotide
tcttcactcagatcattgg

SEQ ID NO: 6134 - DNA, 18 bp, Artificial Sequence
  Synthetic Polynucleotide
gggttgtcgtcttgattg

SEQ ID NO: 6135 - DNA, 19 bp, Artificial Sequence
  Synthetic Polynucleotide
gaatgcactttgaaaccga

SEQ ID NO: 6136 - DNA, 19 bp, Artificial Sequence
  Synthetic Polynucleotide
atgattcaatcaccatgcc

SEQ ID NO: 6137 - DNA, 18 bp, Artificial Sequence
  Synthetic Polynucleotide
cgtcatggttactcactc

SEQ ID NO: 6138 - DNA, 19 bp, Artificial Sequence
  Synthetic Polynucleotide
agtcgaatttgatttcgga

SEQ ID NO: 6139 - DNA, 18 bp, Artificial Sequence
  Synthetic Polynucleotide
aacgcttctcaacattct

SEQ ID NO: 6140 - DNA, 18 bp, Artificial Sequence
  Synthetic Polynucleotide
atacactcccacgctcag

SEQ ID NO: 6141 - DNA, 20 bp, Artificial Sequence
  Synthetic Polynucleotide
agacgcaccttgctctttct

SEQ ID NO: 6142 - DNA, 19 bp, Artificial Sequence
  Synthetic Polynucleotide
gtcttccacgctgatcgac

SEQ ID NO: 6143 - DNA, 19 bp, Artificial Sequence
  Synthetic Polynucleotide
tctagacaaaagtggaaga

SEQ ID NO: 6144 - DNA, 19 bp, Artificial Sequence
  Synthetic Polynucleotide
gattttggagtctctgagg

SEQ ID NO: 6145 - DNA, 17 bp, Artificial Sequence
  Synthetic Polynucleotide
actcggctctaatgaca

SEQ ID NO: 6146 - DNA, 20 bp, Artificial Sequence
  Synthetic Polynucleotide
atgacacatctcgaaatagc

SEQ ID NO: 6147 - DNA, 20 bp, Artificial Sequence
  Synthetic Polynucleotide
caactcatttctcaatcccg

SEQ ID NO: 6148 - DNA, 18 bp, Artificial Sequence
  Synthetic Polynucleotide
gacaagctagaatggtca

SEQ ID NO: 6149 - DNA, 18 bp, Artificial Sequence
  Synthetic Polynucleotide
gaataggcatttctgcaa

SEQ ID NO: 6150 - DNA, 20 bp, Artificial Sequence
  Synthetic Polynucleotide
aatgatgcaatgaaggagat

SEQ ID NO: 6151 - DNA, 19 bp, Artificial Sequence
  Synthetic Polynucleotide
tgttacaaagaagaagcac

SEQ ID NO: 6152 - DNA, 19 bp, Artificial Sequence
  Synthetic Polynucleotide
tgacataatcctttggtcg

SEQ ID NO: 6153 - DNA, 17 bp, Artificial Sequence
  Synthetic Polynucleotide
cccgacatggaactcga

SEQ ID NO: 6154 - DNA, 20 bp, Artificial Sequence
  Synthetic Polynucleotide
ttctttccgtacatttacgc

SEQ ID NO: 6155 - DNA, 20 bp, Artificial Sequence
  Synthetic Polynucleotide
ccaataggggtatagaaggg

SEQ ID NO: 6156 - DNA, 20 bp, Artificial Sequence
  Synthetic Polynucleotide
ttcacattcccagttattca

SEQ ID NO: 6157 - DNA, 17 bp, Artificial Sequence
  Synthetic Polynucleotide
tggggcagttcacaact

SEQ ID NO: 6158 - DNA, 17 bp, Artificial Sequence
  Synthetic Polynucleotide
ggtgttgtaagtaccga

SEQ ID NO: 6159 - DNA, 20 bp, Artificial Sequence
  Synthetic Polynucleotide
catttctcagtttggtgaat

SEQ ID NO: 6160 - DNA, 17 bp, Artificial Sequence
  Synthetic Polynucleotide
ggaacactatgctcgcc

SEQ ID NO: 6161 - DNA, 18 bp, Artificial Sequence
  Synthetic Polynucleotide
catgggactacctcaagg

SEQ ID NO: 6162 - DNA, 19 bp, Artificial Sequence
  Synthetic Polynucleotide
cctttctcattccagaaag

SEQ ID NO: 6163 - DNA, 18 bp, Artificial Sequence
  Synthetic Polynucleotide
gtatcttcacaatcacgg

SEQ ID NO: 6164 - DNA, 17 bp, Artificial Sequence
  Synthetic Polynucleotide
gtgccaatgacaggaag

SEQ ID NO: 6165 - DNA, 17 bp, Artificial Sequence
  Synthetic Polynucleotide
aaatcgttagccaccta

SEQ ID NO: 6166 - DNA, 19 bp, Artificial Sequence
  Synthetic Polynucleotide
ggagttttacttggtcaag

SEQ ID NO: 6167 - DNA, 18 bp, Artificial Sequence
  Synthetic Polynucleotide
acgctacatggtctttat

SEQ ID NO: 6168 - DNA, 17 bp, Artificial Sequence
  Synthetic Polynucleotide
gttggttctccttggtc

SEQ ID NO: 6169 - DNA, 19 bp, Artificial Sequence
  Synthetic Polynucleotide
tgtgcttggttggtaaaga

SEQ ID NO: 6170 - DNA, 20 bp, Artificial Sequence
  Synthetic Polynucleotide
aatacttcctgttcctcccc

SEQ ID NO: 6171 - DNA, 18 bp, Artificial Sequence
  Synthetic Polynucleotide
cctagagggtgggtgctg

SEQ ID NO: 6172 - DNA, 18 bp, Artificial Sequence
  Synthetic Polynucleotide
ccccagttgttgttgatg

SEQ ID NO: 6173 - DNA, 17 bp, Artificial Sequence
  Synthetic Polynucleotide
attggcattgcgattcc

SEQ ID NO: 6174 - DNA, 18 bp, Artificial Sequence
  Synthetic Polynucleotide
cgacaaatgattctcctg

SEQ ID NO: 6175 - DNA, 17 bp, Artificial Sequence
  Synthetic Polynucleotide
gcggcatctgatttggt

SEQ ID NO: 6176 - DNA, 19 bp, Artificial Sequence
  Synthetic Polynucleotide
caagtactcagcatgtata

SEQ ID NO: 6177 - DNA, 19 bp, Artificial Sequence
  Synthetic Polynucleotide
aggtcaaaggtcagtagac

SEQ ID NO: 6178 - DNA, 20 bp, Artificial Sequence
  Synthetic Polynucleotide
ttggtacagtcattaaatgg

SEQ ID NO: 6179 - DNA, 17 bp, Artificial Sequence
  Synthetic Polynucleotide
tggagtagatggttggt

SEQ ID NO: 6180 - DNA, 20 bp, Artificial Sequence
  Synthetic Polynucleotide
aatttgttccactcgtacag

SEQ ID NO: 6181 - DNA, 17 bp, Artificial Sequence
  Synthetic Polynucleotide
ctgcctggaatttctga

SEQ ID NO: 6182 - DNA, 20 bp, Artificial Sequence
  Synthetic Polynucleotide
ttattctcaaaagctctgca

SEQ ID NO: 6183 - DNA, 20 bp, Artificial Sequence
  Synthetic Polynucleotide
attccctgtcagttatcaac

SEQ ID NO: 6184 - DNA, 19 bp, Artificial Sequence
  Synthetic Polynucleotide
caagtagagtcgtagctct

SEQ ID NO: 6185 - DNA, 19 bp, Artificial Sequence
  Synthetic Polynucleotide
cttggtcctacgtcatcaa

SEQ ID NO: 6186 - DNA, 19 bp, Artificial Sequence
  Synthetic Polynucleotide
gtctctgaaagatgatacg

SEQ ID NO: 6187 - DNA, 19 bp, Artificial Sequence
  Synthetic Polynucleotide
tttgggtaaaatcaccaaa

SEQ ID NO: 6188 - DNA, 18 bp, Artificial Sequence
  Synthetic Polynucleotide
ctgttcccgtcaatcacg

SEQ ID NO: 6189 - DNA, 17 bp, Artificial Sequence
  Synthetic Polynucleotide
gcggtcccagatcaagg

SEQ ID NO: 6190 - DNA, 17 bp, Artificial Sequence
  Synthetic Polynucleotide
agggttcgttcgttcga

SEQ ID NO: 6191 - DNA, 19 bp, Artificial Sequence
  Synthetic Polynucleotide
gcatgttcgctcattcaca

SEQ ID NO: 6192 - DNA, 17 bp, Artificial Sequence
  Synthetic Polynucleotide
atcactagcagcaagtc

SEQ ID NO: 6193 - DNA, 20 bp, Artificial Sequence
  Synthetic Polynucleotide
caggatatagtgaaatacgg

SEQ ID NO: 6194 - DNA, 20 bp, Artificial Sequence
  Synthetic Polynucleotide
tcgttccattcttcttttaa

SEQ ID NO: 6195 - DNA, 19 bp, Artificial Sequence
  Synthetic Polynucleotide
accagtgtcacaatttaac

SEQ ID NO: 6196 - DNA, 19 bp, Artificial Sequence
  Synthetic Polynucleotide
cgtcttccatgtgataatt

SEQ ID NO: 6197 - DNA, 19 bp, Artificial Sequence
  Synthetic Polynucleotide
gaactcaggtatgttgttc

SEQ ID NO: 6198 - DNA, 17 bp, Artificial Sequence
  Synthetic Polynucleotide
gtgtgtatactggggcg

SEQ ID NO: 6199 - DNA, 20 bp, Artificial Sequence
  Synthetic Polynucleotide
gtgacatcaccaacttcgat

SEQ ID NO: 6200 - DNA, 20 bp, Artificial Sequence
  Synthetic Polynucleotide
ttgttaagtaagtgtgcagt

SEQ ID NO: 6201 - DNA, 18 bp, Artificial Sequence
  Synthetic Polynucleotide
taagttctccatttccct

SEQ ID NO: 6202 - DNA, 18 bp, Artificial Sequence
  Synthetic Polynucleotide
tcctttgatccaggttac

SEQ ID NO: 6203 - DNA, 18 bp, Artificial Sequence
  Synthetic Polynucleotide
acacaggaggaaacagca

SEQ ID NO: 6204 - DNA, 20 bp, Artificial Sequence
  Synthetic Polynucleotide
tgcagtagcctaaattaaca

SEQ ID NO: 6205 - DNA, 19 bp, Artificial Sequence
  Synthetic Polynucleotide
ctgactcactctgttcgta

SEQ ID NO: 6206 - DNA, 18 bp, Artificial Sequence
  Synthetic Polynucleotide
gtttcttggatttcccac

SEQ ID NO: 6207 - DNA, 19 bp, Artificial Sequence
  Synthetic Polynucleotide
atattaatgaggtggcgaa

SEQ ID NO: 6208 - DNA, 20 bp, Artificial Sequence
  Synthetic Polynucleotide
gtctctcaagtgaactggtt

SEQ ID NO: 6209 - DNA, 20 bp, Artificial Sequence
  Synthetic Polynucleotide
ctaaggttagcttttgactc

SEQ ID NO: 6210 - DNA, 18 bp, Artificial Sequence
  Synthetic Polynucleotide
gtgacttttgtctggttc

SEQ ID NO: 6211 - DNA, 18 bp, Artificial Sequence
  Synthetic Polynucleotide
gaactatatggacagggc

SEQ ID NO: 6212 - DNA, 18 bp, Artificial Sequence
  Synthetic Polynucleotide
gatatcagcgagcttggc

SEQ ID NO: 6213 - DNA, 17 bp, Artificial Sequence
  Synthetic Polynucleotide
actctactcaacgagga

SEQ ID NO: 6214 - DNA, 19 bp, Artificial Sequence
  Synthetic Polynucleotide
atgcgtattttcttggttt

SEQ ID NO: 6215 - DNA, 17 bp, Artificial Sequence
  Synthetic Polynucleotide
cggtaggcgagttaaaa

SEQ ID NO: 6216 - DNA, 20 bp, Artificial Sequence
  Synthetic Polynucleotide
tcgatttccattgcttccat

SEQ ID NO: 6217 - DNA, 19 bp, Artificial Sequence
  Synthetic Polynucleotide
gaaacagtaatgacagggg

SEQ ID NO: 6218 - DNA, 20 bp, Artificial Sequence
  Synthetic Polynucleotide
aaattgtacggtcaagatct

SEQ ID NO: 6219 - DNA, 19 bp, Artificial Sequence
  Synthetic Polynucleotide
aaatcttgacactctggtt

SEQ ID NO: 6220 - DNA, 18 bp, Artificial Sequence
  Synthetic Polynucleotide
aaatttccccgaatttcc

SEQ ID NO: 6221 - DNA, 18 bp, Artificial Sequence
  Synthetic Polynucleotide
caggttcgggtgctaatg

SEQ ID NO: 6222 - DNA, 18 bp, Artificial Sequence
  Synthetic Polynucleotide
cttcttcaaccagacccc

SEQ ID NO: 6223 - DNA, 19 bp, Artificial Sequence
  Synthetic Polynucleotide
cgatcaggtactcgtgggg

SEQ ID NO: 6224 - DNA, 20 bp, Artificial Sequence
  Synthetic Polynucleotide
gccattgtgattgttggata

SEQ ID NO: 6225 - DNA, 19 bp, Artificial Sequence
  Synthetic Polynucleotide
aacatttagtgttccgtta

SEQ ID NO: 6226 - DNA, 18 bp, Artificial Sequence
  Synthetic Polynucleotide
ctctctctttctcactgg

SEQ ID NO: 6227 - DNA, 17 bp, Artificial Sequence
  Synthetic Polynucleotide
ggtgacttcggctacag

SEQ ID NO: 6228 - DNA, 17 bp, Artificial Sequence
  Synthetic Polynucleotide
cccaaagtagtcggttc

SEQ ID NO: 6229 - DNA, 17 bp, Artificial Sequence
  Synthetic Polynucleotide
cccctgaatgcggctaa

SEQ ID NO: 6230 - DNA, 18 bp, Artificial Sequence
  Synthetic Polynucleotide
cgcaggtaaagtgatctg

SEQ ID NO: 6231 - DNA, 17 bp, Artificial Sequence
  Synthetic Polynucleotide
atcctctcctttgcacg

SEQ ID NO: 6232 - DNA, 18 bp, Artificial Sequence
  Synthetic Polynucleotide
aaaacctaaatgcccctg

SEQ ID NO: 6233 - DNA, 17 bp, Artificial Sequence
  Synthetic Polynucleotide
gatagggtaacagcggc

SEQ ID NO: 6234 - DNA, 20 bp, Artificial Sequence
  Synthetic Polynucleotide
agagcatgtcctgtcctttt

SEQ ID NO: 6235 - DNA, 17 bp, Artificial Sequence
  Synthetic Polynucleotide
gtcttcagtttcggagc

SEQ ID NO: 6236 - DNA, 19 bp, Artificial Sequence
  Synthetic Polynucleotide
cttttacattttcccatgc

SEQ ID NO: 6237 - DNA, 18 bp, Artificial Sequence
  Synthetic Polynucleotide
catcaatggctcaaaccc

SEQ ID NO: 6238 - DNA, 18 bp, Artificial Sequence
  Synthetic Polynucleotide
agactccttctctcaaca

SEQ ID NO: 6239 - DNA, 18 bp, Artificial Sequence
  Synthetic Polynucleotide
cgagtcccacacactata

SEQ ID NO: 6240 - DNA, 19 bp, Artificial Sequence
  Synthetic Polynucleotide
cacccaaagtagtcggttc

SEQ ID NO: 6241 - DNA, 18 bp, Artificial Sequence
  Synthetic Polynucleotide
agatcaggtcgatgagtc

SEQ ID NO: 6242 - DNA, 19 bp, Artificial Sequence
  Synthetic Polynucleotide
ttcacagcagtagatggtg

SEQ ID NO: 6243 - DNA, 18 bp, Artificial Sequence
  Synthetic Polynucleotide
agcccagcgttaatagcg

SEQ ID NO: 6244 - DNA, 17 bp, Artificial Sequence
  Synthetic Polynucleotide
tggcccactagacgttt

SEQ ID NO: 6245 - DNA, 19 bp, Artificial Sequence
  Synthetic Polynucleotide
caaacactagttgtaaggc

SEQ ID NO: 6246 - DNA, 18 bp, Artificial Sequence
  Synthetic Polynucleotide
gctcaaagtccatgacgg

SEQ ID NO: 6247 - DNA, 20 bp, Artificial Sequence
  Synthetic Polynucleotide
tgctaactaaatccctagca

SEQ ID NO: 6248 - DNA, 17 bp, Artificial Sequence
  Synthetic Polynucleotide
acctggaggtagaacgt

SEQ ID NO: 6249 - DNA, 20 bp, Artificial Sequence
  Synthetic Polynucleotide
tctatgattctgatgtccaa

SEQ ID NO: 6250 - DNA, 18 bp, Artificial Sequence
  Synthetic Polynucleotide
gaattctttccctcagcc

SEQ ID NO: 6251 - DNA, 18 bp, Artificial Sequence
  Synthetic Polynucleotide
atctttcccatccttgtc

SEQ ID NO: 6252 - DNA, 20 bp, Artificial Sequence
  Synthetic Polynucleotide
gccaaattcaatcaaatcaa

SEQ ID NO: 6253 - DNA, 17 bp, Artificial Sequence
  Synthetic Polynucleotide
gaatcaatggcgagtgt

SEQ ID NO: 6254 - DNA, 18 bp, Artificial Sequence
  Synthetic Polynucleotide
cgaaagtagtctgttccg

SEQ ID NO: 6255 - DNA, 17 bp, Artificial Sequence
  Synthetic Polynucleotide
acggtcaagcacttctg

SEQ ID NO: 6256 - DNA, 18 bp, Artificial Sequence
  Synthetic Polynucleotide
accaagtttcttccacta

SEQ ID NO: 6257 - DNA, 18 bp, Artificial Sequence
  Synthetic Polynucleotide
tgctatcccatgatagtc

SEQ ID NO: 6258 - DNA, 17 bp, Artificial Sequence
  Synthetic Polynucleotide
acgacgtagcaacactg

SEQ ID NO: 6259 - DNA, 20 bp, Artificial Sequence
  Synthetic Polynucleotide
tttgtacgcctgttttcccc

SEQ ID NO: 6260 - DNA, 17 bp, Artificial Sequence
  Synthetic Polynucleotide
aacacggacacccaaag

SEQ ID NO: 6261 - DNA, 17 bp, Artificial Sequence
  Synthetic Polynucleotide
cccctgaatgcggctaa

SEQ ID NO: 6262 - DNA, 19 bp, Artificial Sequence
  Synthetic Polynucleotide
ccattgtcagtaccaatct

SEQ ID NO: 6263 - DNA, 20 bp, Artificial Sequence
  Synthetic Polynucleotide
cgaaagcaatccattcttaa

SEQ ID NO: 6264 - DNA, 19 bp, Artificial Sequence
  Synthetic Polynucleotide
tggacaacactcttcatca

SEQ ID NO: 6265 - DNA, 17 bp, Artificial Sequence
  Synthetic Polynucleotide
tggctggctcaagaaat

SEQ ID NO: 6266 - DNA, 20 bp, Artificial Sequence
  Synthetic Polynucleotide
aacacggacacccaaagtag

SEQ ID NO: 6267 - DNA, 20 bp, Artificial Sequence
  Synthetic Polynucleotide
ccctgaatgtggctaacctt

SEQ ID NO: 6268 - DNA, 20 bp, Artificial Sequence
  Synthetic Polynucleotide
gtctggcataactgggaatc

SEQ ID NO: 6269 - DNA, 17 bp, Artificial Sequence
  Synthetic Polynucleotide
accaggtccctcatgtg

SEQ ID NO: 6270 - DNA, 19 bp, Artificial Sequence
  Synthetic Polynucleotide
ttctgtcctaaatcatcca

SEQ ID NO: 6271 - DNA, 20 bp, Artificial Sequence
  Synthetic Polynucleotide
ctgtatggtatagttacagc

SEQ ID NO: 6272 - DNA, 17 bp, Artificial Sequence
  Synthetic Polynucleotide
gcacgataaaaggagca

SEQ ID NO: 6273 - DNA, 17 bp, Artificial Sequence
  Synthetic Polynucleotide
cttccattgacggcttc

SEQ ID NO: 6274 - DNA, 18 bp, Artificial Sequence
  Synthetic Polynucleotide
agcttcatcatcttccac

SEQ ID NO: 6275 - DNA, 19 bp, Artificial Sequence
  Synthetic Polynucleotide
tggtagtttatgaacccaa

SEQ ID NO: 6276 - DNA, 19 bp, Artificial Sequence
  Synthetic Polynucleotide
gacaagtaagtcatctcca

SEQ ID NO: 6277 - DNA, 17 bp, Artificial Sequence
  Synthetic Polynucleotide
ctcactcaaaccccaag

SEQ ID NO: 6278 - DNA, 18 bp, Artificial Sequence
  Synthetic Polynucleotide
acatctctcagctcgaac

SEQ ID NO: 6279 - DNA, 20 bp, Artificial Sequence
  Synthetic Polynucleotide
ccctagtggctcaatcacca

SEQ ID NO: 6280 - DNA, 18 bp, Artificial Sequence
  Synthetic Polynucleotide
ctttatgttcgccctatc

SEQ ID NO: 6281 - DNA, 18 bp, Artificial Sequence
  Synthetic Polynucleotide
actggtcttagcaatacc

SEQ ID NO: 6282 - DNA, 20 bp, Artificial Sequence
  Synthetic Polynucleotide
gctctgatacacagaactct

SEQ ID NO: 6283 - DNA, 19 bp, Artificial Sequence
  Synthetic Polynucleotide
acaagttttcaaaatggca

SEQ ID NO: 6284 - DNA, 20 bp, Artificial Sequence
  Synthetic Polynucleotide
cactttgtggttatagctca

SEQ ID NO: 6285 - DNA, 17 bp, Artificial Sequence
  Synthetic Polynucleotide
gtaaaggtcaaatggcc

SEQ ID NO: 6286 - DNA, 17 bp, Artificial Sequence
  Synthetic Polynucleotide
acgaccagtcttgactc

SEQ ID NO: 6287 - DNA, 20 bp, Artificial Sequence
  Synthetic Polynucleotide
taacgagattatccgtaagc

SEQ ID NO: 6288 - DNA, 18 bp, Artificial Sequence
  Synthetic Polynucleotide
ttcgatttcgtctactgc

SEQ ID NO: 6289 - DNA, 18 bp, Artificial Sequence
  Synthetic Polynucleotide
gctcacgtctgctcagtg

SEQ ID NO: 6290 - DNA, 18 bp, Artificial Sequence
  Synthetic Polynucleotide
tcgaagggaaaaccgtca

SEQ ID NO: 6291 - DNA, 18 bp, Artificial Sequence
  Synthetic Polynucleotide
taccaggaatcagccacg

SEQ ID NO: 6292 - DNA, 19 bp, Artificial Sequence
  Synthetic Polynucleotide
catcgtgtacgttgttgat

SEQ ID NO: 6293 - DNA, 19 bp, Artificial Sequence
  Synthetic Polynucleotide
aggggatgctccagtacgt

SEQ ID NO: 6294 - DNA, 17 bp, Artificial Sequence
  Synthetic Polynucleotide
agcgtttcagctcttgt

SEQ ID NO: 6295 - DNA, 19 bp, Artificial Sequence
  Synthetic Polynucleotide
tggattgataagcgtattg

SEQ ID NO: 6296 - DNA, 19 bp, Artificial Sequence
  Synthetic Polynucleotide
tgaccactattaccaaaga

SEQ ID NO: 6297 - DNA, 18 bp, Artificial Sequence
  Synthetic Polynucleotide
gaaccgcattttggacaa

SEQ ID NO: 6298 - DNA, 18 bp, Artificial Sequence
  Synthetic Polynucleotide
cgagttcaccgacaagaa

SEQ ID NO: 6299 - DNA, 19 bp, Artificial Sequence
  Synthetic Polynucleotide
tacccaagttgaacccacg

SEQ ID NO: 6300 - DNA, 19 bp, Artificial Sequence
  Synthetic Polynucleotide
caatggaatatgcacaaag

SEQ ID NO: 6301 - DNA, 19 bp, Artificial Sequence
  Synthetic Polynucleotide
gctcttttctagcttctct

SEQ ID NO: 6302 - DNA, 19 bp, Artificial Sequence
  Synthetic Polynucleotide
tcatgcaagcaaaatttag

SEQ ID NO: 6303 - DNA, 19 bp, Artificial Sequence
  Synthetic Polynucleotide
ttgtaccatgaccaccctg

SEQ ID NO: 6304 - DNA, 17 bp, Artificial Sequence
  Synthetic Polynucleotide
gatgtagccattcaggg

SEQ ID NO: 6305 - DNA, 17 bp, Artificial Sequence
  Synthetic Polynucleotide
gaacatcattgacctgc

SEQ ID NO: 6306 - DNA, 17 bp, Artificial Sequence
  Synthetic Polynucleotide
ctggatatctgccgcct

SEQ ID NO: 6307 - DNA, 17 bp, Artificial Sequence
  Synthetic Polynucleotide
ccaaacatcgaagccat

SEQ ID NO: 6308 - DNA, 18 bp, Artificial Sequence
  Synthetic Polynucleotide
atgtcattgccatagtta

SEQ ID NO: 6309 - DNA, 19 bp, Artificial Sequence
  Synthetic Polynucleotide
aataccacccactctattg

SEQ ID NO: 6310 - DNA, 19 bp, Artificial Sequence
  Synthetic Polynucleotide
ctttctcacgtagaacctt

SEQ ID NO: 6311 - DNA, 20 bp, Artificial Sequence
  Synthetic Polynucleotide
agattatcctcatgttcgac

SEQ ID NO: 6312 - DNA, 17 bp, Artificial Sequence
  Synthetic Polynucleotide
tttgtttcaccgcccaa

SEQ ID NO: 6313 - DNA, 18 bp, Artificial Sequence
  Synthetic Polynucleotide
tcctcagttacaggaatg

SEQ ID NO: 6314 - DNA, 19 bp, Artificial Sequence
  Synthetic Polynucleotide
caatgcctttccgcacctt

SEQ ID NO: 6315 - DNA, 20 bp, Artificial Sequence
  Synthetic Polynucleotide
gttgaatccgtcctcctacg

SEQ ID NO: 6316 - DNA, 17 bp, Artificial Sequence
  Synthetic Polynucleotide
ggagcataatacgggta

SEQ ID NO: 6317 - DNA, 18 bp, Artificial Sequence
  Synthetic Polynucleotide
gctatttgcggaatgctt

SEQ ID NO: 6318 - DNA, 19 bp, Artificial Sequence
  Synthetic Polynucleotide
ttacgcttgctgggctact

SEQ ID NO: 6319 - DNA, 17 bp, Artificial Sequence
  Synthetic Polynucleotide
ggacagctcaatggcat

SEQ ID NO: 6320 - DNA, 20 bp, Artificial Sequence
  Synthetic Polynucleotide
ctggtcttctggagttgggt

SEQ ID NO: 6321 - DNA, 18 bp, Artificial Sequence
  Synthetic Polynucleotide
gatcccaatcgttctgac

SEQ ID NO: 6322 - DNA, 20 bp, Artificial Sequence
  Synthetic Polynucleotide
taattgtctggctaaatttc

SEQ ID NO: 6323 - DNA, 20 bp, Artificial Sequence
  Synthetic Polynucleotide
tcaaaagtgcaatcaggata

SEQ ID NO: 6324 - DNA, 18 bp, Artificial Sequence
  Synthetic Polynucleotide
tcaggtacaaggtaacct

SEQ ID NO: 6325 - DNA, 19 bp, Artificial Sequence
  Synthetic Polynucleotide
tgcgactgtagactttgaa

SEQ ID NO: 6326 - DNA, 17 bp, Artificial Sequence
  Synthetic Polynucleotide
cacatcggtactcttgc

SEQ ID NO: 6327 - DNA, 18 bp, Artificial Sequence
  Synthetic Polynucleotide
cagggtatgtgggtggtg

SEQ ID NO: 6328 - DNA, 19 bp, Artificial Sequence
  Synthetic Polynucleotide
gttcgaggactaattacct

SEQ ID NO: 6329 - DNA, 20 bp, Artificial Sequence
  Synthetic Polynucleotide
agactgagacttcgtcaacc

SEQ ID NO: 6330 - DNA, 17 bp, Artificial Sequence
  Synthetic Polynucleotide
actgaggacaagactgc

SEQ ID NO: 6331 - DNA, 17 bp, Artificial Sequence
  Synthetic Polynucleotide
aggcttccactcttggt

SEQ ID NO: 6332 - DNA, 20 bp, Artificial Sequence
  Synthetic Polynucleotide
gatcaccttcttctccttca

SEQ ID NO: 6333 - DNA, 20 bp, Artificial Sequence
  Synthetic Polynucleotide
agaagttcgactacaacctc

SEQ ID NO: 6334 - DNA, 19 bp, Artificial Sequence
  Synthetic Polynucleotide
ggttaggaacatcggggta

SEQ ID NO: 6335 - DNA, 17 bp, Artificial Sequence
  Synthetic Polynucleotide
caacggcctaaacgccc

SEQ ID NO: 6336 - DNA, 17 bp, Artificial Sequence
  Synthetic Polynucleotide
ctaagctaggggctaac

SEQ ID NO: 6337 - DNA, 20 bp, Artificial Sequence
  Synthetic Polynucleotide
atctctctcaacatcttagc

SEQ ID NO: 6338 - DNA, 18 bp, Artificial Sequence
  Synthetic Polynucleotide
tatcgtttctcctaaacc

SEQ ID NO: 6339 - DNA, 20 bp, Artificial Sequence
  Synthetic Polynucleotide
ttactttatcaccttctgcc

SEQ ID NO: 6340 - DNA, 18 bp, Artificial Sequence
  Synthetic Polynucleotide
gaggatcttcgctttgct

SEQ ID NO: 6341 - DNA, 18 bp, Artificial Sequence
  Synthetic Polynucleotide
catggcttcgtgacatgc

SEQ ID NO: 6342 - DNA, 17 bp, Artificial Sequence
  Synthetic Polynucleotide
gtaggggactgctttgg

SEQ ID NO: 6343 - DNA, 19 bp, Artificial Sequence
  Synthetic Polynucleotide
ccggtttataatggacaaa

SEQ ID NO: 6344 - DNA, 18 bp, Artificial Sequence
  Synthetic Polynucleotide
tcaccaattaacggtagc

SEQ ID NO: 6345 - DNA, 20 bp, Artificial Sequence
  Synthetic Polynucleotide
gcggtatactcaatggtatt

SEQ ID NO: 6346 - DNA, 17 bp, Artificial Sequence
  Synthetic Polynucleotide
cccattttcttcacgcc

SEQ ID NO: 6347 - DNA, 18 bp, Artificial Sequence
  Synthetic Polynucleotide
acacctgccgcttaacct

SEQ ID NO: 6348 - DNA, 19 bp, Artificial Sequence
  Synthetic Polynucleotide
gttgcgtcatagtgcttta

SEQ ID NO: 6349 - DNA, 18 bp, Artificial Sequence
  Synthetic Polynucleotide
gctttaagaatcggagtc

SEQ ID NO: 6350 - DNA, 18 bp, Artificial Sequence
  Synthetic Polynucleotide
cttgccatagaggctatt

SEQ ID NO: 6351 - DNA, 19 bp, Artificial Sequence
  Synthetic Polynucleotide
taagccattgagaatttgc

SEQ ID NO: 6352 - DNA, 20 bp, Artificial Sequence
  Synthetic Polynucleotide
aaataatgctgtgaagcggg

SEQ ID NO: 6353 - DNA, 20 bp, Artificial Sequence
  Synthetic Polynucleotide
cctttctcaatcctttccta

SEQ ID NO: 6354 - DNA, 17 bp, Artificial Sequence
  Synthetic Polynucleotide
agacgaatccaacgagc

SEQ ID NO: 6355 - DNA, 17 bp, Artificial Sequence
  Synthetic Polynucleotide
cgtggctgtggtatttt

SEQ ID NO: 6356 - DNA, 19 bp, Artificial Sequence
  Synthetic Polynucleotide
gtggctgtggtattttata

SEQ ID NO: 6357 - DNA, 17 bp, Artificial Sequence
  Synthetic Polynucleotide
gtgacgaatccaacgag

SEQ ID NO: 6358 - DNA, 20 bp, Artificial Sequence
  Synthetic Polynucleotide
aggttgtagatcagtattcc

SEQ ID NO: 6359 - DNA, 20 bp, Artificial Sequence
  Synthetic Polynucleotide
gagacctcaaatactgtcag

SEQ ID NO: 6360 - DNA, 20 bp, Artificial Sequence
  Synthetic Polynucleotide
caagtacgttccaaaattgt

SEQ ID NO: 6361 - DNA, 20 bp, Artificial Sequence
  Synthetic Polynucleotide
ccacgttcataagactatta

SEQ ID NO: 6362 - DNA, 19 bp, Artificial Sequence
  Synthetic Polynucleotide
ttcatcctctagtcgagat

SEQ ID NO: 6363 - DNA, 19 bp, Artificial Sequence
  Synthetic Polynucleotide
tttcatcgcaattagtgaa

SEQ ID NO: 6364 - DNA, 19 bp, Artificial Sequence
  Synthetic Polynucleotide
tatatcgtatgagctgaga

SEQ ID NO: 6365 - DNA, 18 bp, Artificial Sequence
  Synthetic Polynucleotide
agcatagtggtcattgaa

SEQ ID NO: 6366 - DNA, 18 bp, Artificial Sequence
  Synthetic Polynucleotide
cataagctaaggtgggat

SEQ ID NO: 6367 - DNA, 17 bp, Artificial Sequence
  Synthetic Polynucleotide
aacaacttccgtgtccc

SEQ ID NO: 6368 - DNA, 17 bp, Artificial Sequence
  Synthetic Polynucleotide
agacaaatccaacgagc

SEQ ID NO: 6369 - DNA, 20 bp, Artificial Sequence
  Synthetic Polynucleotide
agcatataggactagctata

SEQ ID NO: 6370 - DNA, 17 bp, Artificial Sequence
  Synthetic Polynucleotide
acaatgtggcgggtgtg

SEQ ID NO: 6371 - DNA, 19 bp, Artificial Sequence
  Synthetic Polynucleotide
tcactatttcagtttcaga

SEQ ID NO: 6372 - DNA, 17 bp, Artificial Sequence
  Synthetic Polynucleotide
tggttttgatcgcatca

SEQ ID NO: 6373 - DNA, 20 bp, Artificial Sequence
  Synthetic Polynucleotide
tcgtatctaatattggcttg

SEQ ID NO: 6374 - DNA, 20 bp, Artificial Sequence
  Synthetic Polynucleotide
gtggtaaaagcactttgatt

SEQ ID NO: 6375 - DNA, 19 bp, Artificial Sequence
  Synthetic Polynucleotide
tgtggagaaggcaggtaag

SEQ ID NO: 6376 - DNA, 19 bp, Artificial Sequence
  Synthetic Polynucleotide
ttcacttctccatgagatt

SEQ ID NO: 6377 - DNA, 18 bp, Artificial Sequence
  Synthetic Polynucleotide
aagaaaactctgggtgat

SEQ ID NO: 6378 - DNA, 19 bp, Artificial Sequence
  Synthetic Polynucleotide
aggtcccaggaataaatga

SEQ ID NO: 6379 - DNA, 18 bp, Artificial Sequence
  Synthetic Polynucleotide
atggggtaaaacttgacc

SEQ ID NO: 6380 - DNA, 20 bp, Artificial Sequence
  Synthetic Polynucleotide
tatgtctaaacatcagtcat

SEQ ID NO: 6381 - DNA, 20 bp, Artificial Sequence
  Synthetic Polynucleotide
ccgtgtttctgtgattaact

SEQ ID NO: 6382 - DNA, 18 bp, Artificial Sequence
  Synthetic Polynucleotide
aagttcgcacttgttctg

SEQ ID NO: 6383 - DNA, 17 bp, Artificial Sequence
  Synthetic Polynucleotide
tggactctcactcgaac

SEQ ID NO: 6384 - DNA, 19 bp, Artificial Sequence
  Synthetic Polynucleotide
tataaaataccacagccac

SEQ ID NO: 6385 - DNA, 18 bp, Artificial Sequence
  Synthetic Polynucleotide
aaagccatgcagcaaatc

SEQ ID NO: 6386 - DNA, 18 bp, Artificial Sequence
  Synthetic Polynucleotide
cagcttgtctacgtgata

SEQ ID NO: 6387 - DNA, 19 bp, Artificial Sequence
  Synthetic Polynucleotide
acattcatgcaaattacgt

SEQ ID NO: 6388 - DNA, 17 bp, Artificial Sequence
  Synthetic Polynucleotide
gccttacccactcacca

SEQ ID NO: 6389 - DNA, 17 bp, Artificial Sequence
  Synthetic Polynucleotide
ctaaacagtcgcacaac

SEQ ID NO: 6390 - DNA, 17 bp, Artificial Sequence
  Synthetic Polynucleotide
caacgctactcagaggc

SEQ ID NO: 6391 - DNA, 18 bp, Artificial Sequence
  Synthetic Polynucleotide
tagaggtttacggcaacc

SEQ ID NO: 6392 - DNA, 19 bp, Artificial Sequence
  Synthetic Polynucleotide
ccgctagaaaagagatcta

SEQ ID NO: 6393 - DNA, 19 bp, Artificial Sequence
  Synthetic Polynucleotide
tttgtccccaaaggaggaa

SEQ ID NO: 6394 - DNA, 19 bp, Artificial Sequence
  Synthetic Polynucleotide
tgcatacgatcttactcta

SEQ ID NO: 6395 - DNA, 18 bp, Artificial Sequence
  Synthetic Polynucleotide
cacgaccaatacatgatg

SEQ ID NO: 6396 - DNA, 17 bp, Artificial Sequence
  Synthetic Polynucleotide
tccatgaaatatccgcc

SEQ ID NO: 6397 - DNA, 18 bp, Artificial Sequence
  Synthetic Polynucleotide
tgacggatacttatgctt

SEQ ID NO: 6398 - DNA, 19 bp, Artificial Sequence
  Synthetic Polynucleotide
tagatccacaagtcccatt

SEQ ID NO: 6399 - DNA, 18 bp, Artificial Sequence
  Synthetic Polynucleotide
aagaaaattgtcgccttt

SEQ ID NO: 6400 - DNA, 18 bp, Artificial Sequence
  Synthetic Polynucleotide
tgctcgaatctcgacggg

SEQ ID NO: 6401 - DNA, 20 bp, Artificial Sequence
  Synthetic Polynucleotide
tgtgtatattccatctccac

SEQ ID NO: 6402 - DNA, 20 bp, Artificial Sequence
  Synthetic Polynucleotide
acaacgattaaccgcaaagc

SEQ ID NO: 6403 - DNA, 17 bp, Artificial Sequence
  Synthetic Polynucleotide
agttatggtttcgaccg

SEQ ID NO: 6404 - DNA, 17 bp, Artificial Sequence
  Synthetic Polynucleotide
tgttcttctcgctgacg

SEQ ID NO: 6405 - DNA, 17 bp, Artificial Sequence
  Synthetic Polynucleotide
gctggacactcatcgtg

SEQ ID NO: 6406 - DNA, 20 bp, Artificial Sequence
  Synthetic Polynucleotide
tagagttttcacattcagta

SEQ ID NO: 6407 - DNA, 18 bp, Artificial Sequence
  Synthetic Polynucleotide
ttacagctcataacggct

SEQ ID NO: 6408 - DNA, 19 bp, Artificial Sequence
  Synthetic Polynucleotide
tcaaagttgtactcgattt

SEQ ID NO: 6409 - DNA, 18 bp, Artificial Sequence
  Synthetic Polynucleotide
aggatgtaatgaaccgac

SEQ ID NO: 6410 - DNA, 19 bp, Artificial Sequence
  Synthetic Polynucleotide
catgaggcatatactggag

SEQ ID NO: 6411 - DNA, 19 bp, Artificial Sequence
  Synthetic Polynucleotide
aatctgctagtttgtttcc

SEQ ID NO: 6412 - DNA, 17 bp, Artificial Sequence
  Synthetic Polynucleotide
tcttctccacatacgta

SEQ ID NO: 6413 - DNA, 20 bp, Artificial Sequence
  Synthetic Polynucleotide
gcacatagttatcgttggga

SEQ ID NO: 6414 - DNA, 18 bp, Artificial Sequence
  Synthetic Polynucleotide
tcacccgttttacgcaaa

SEQ ID NO: 6415 - DNA, 18 bp, Artificial Sequence
  Synthetic Polynucleotide
aagctcaccttcatggtt

SEQ ID NO: 6416 - DNA, 20 bp, Artificial Sequence
  Synthetic Polynucleotide
catggctcgtttaacctcgc

SEQ ID NO: 6417 - DNA, 20 bp, Artificial Sequence
  Synthetic Polynucleotide
tagttctgagagaatagcat

SEQ ID NO: 6418 - DNA, 19 bp, Artificial Sequence
  Synthetic Polynucleotide
attttctagagagtaggcc

SEQ ID NO: 6419 - DNA, 19 bp, Artificial Sequence
  Synthetic Polynucleotide
ggcatttgtataagtcaga

SEQ ID NO: 6420 - DNA, 19 bp, Artificial Sequence
  Synthetic Polynucleotide
gctggcattggtcgaaaag

SEQ ID NO: 6421 - DNA, 18 bp, Artificial Sequence
  Synthetic Polynucleotide
ttttgccgttctacatga

SEQ ID NO: 6422 - DNA, 20 bp, Artificial Sequence
  Synthetic Polynucleotide
attagattcttcttcactgc

SEQ ID NO: 6423 - DNA, 20 bp, Artificial Sequence
  Synthetic Polynucleotide
gtatcttccatgtcccgtaa

SEQ ID NO: 6424 - DNA, 19 bp, Artificial Sequence
  Synthetic Polynucleotide
cttacatatggctttggaa

SEQ ID NO: 6425 - DNA, 17 bp, Artificial Sequence
  Synthetic Polynucleotide
tctgctcggtgctaagt

SEQ ID NO: 6426 - DNA, 20 bp, Artificial Sequence
  Synthetic Polynucleotide
atagcagtacactcctagct

SEQ ID NO: 6427 - DNA, 19 bp, Artificial Sequence
  Synthetic Polynucleotide
tgtacccaccacacatttt

SEQ ID NO: 6428 - DNA, 18 bp, Artificial Sequence
  Synthetic Polynucleotide
agattgaaattggttgcc

SEQ ID NO: 6429 - DNA, 19 bp, Artificial Sequence
  Synthetic Polynucleotide
taaaaccctcatcactgaa

SEQ ID NO: 6430 - DNA, 18 bp, Artificial Sequence
  Synthetic Polynucleotide
gggatttgagacaagggc

SEQ ID NO: 6431 - DNA, 18 bp, Artificial Sequence
  Synthetic Polynucleotide
tcgttgttcattttgcag

SEQ ID NO: 6432 - DNA, 20 bp, Artificial Sequence
  Synthetic Polynucleotide
aagactggaattacccacca

SEQ ID NO: 6433 - DNA, 17 bp, Artificial Sequence
  Synthetic Polynucleotide
ccaatcgtctgaattcg

SEQ ID NO: 6434 - DNA, 19 bp, Artificial Sequence
  Synthetic Polynucleotide
cgttcgctttgttctggaa

SEQ ID NO: 6435 - DNA, 20 bp, Artificial Sequence
  Synthetic Polynucleotide
tgcttctgaatttatctcga

SEQ ID NO: 6436 - DNA, 20 bp, Artificial Sequence
  Synthetic Polynucleotide
gtttaaattgatcgttgcaa

SEQ ID NO: 6437 - DNA, 19 bp, Artificial Sequence
  Synthetic Polynucleotide
ttgctttcctttacgcata

SEQ ID NO: 6438 - DNA, 20 bp, Artificial Sequence
  Synthetic Polynucleotide
cggatgcttgttaaggactg

SEQ ID NO: 6439 - DNA, 20 bp, Artificial Sequence
  Synthetic Polynucleotide
ctgtcgttattggatcgtgc

SEQ ID NO: 6440 - DNA, 18 bp, Artificial Sequence
  Synthetic Polynucleotide
ttaccaccttacttcacg

SEQ ID NO: 6441 - DNA, 17 bp, Artificial Sequence
  Synthetic Polynucleotide
tctggttctaggctcgt

SEQ ID NO: 6442 - DNA, 17 bp, Artificial Sequence
  Synthetic Polynucleotide
tttcggaggactttcgt

SEQ ID NO: 6443 - DNA, 18 bp, Artificial Sequence
  Synthetic Polynucleotide
tgaattctgcacagccat

SEQ ID NO: 6444 - DNA, 19 bp, Artificial Sequence
  Synthetic Polynucleotide
tttggcgattcaaactttt

SEQ ID NO: 6445 - DNA, 19 bp, Artificial Sequence
  Synthetic Polynucleotide
gtggctgtggtattttata

SEQ ID NO: 6446 - DNA, 17 bp, Artificial Sequence
  Synthetic Polynucleotide
tgtggcgagtatggcag

SEQ ID NO: 6447 - DNA, 17 bp, Artificial Sequence
  Synthetic Polynucleotide
cgcattggaagcacgtc

SEQ ID NO: 6448 - DNA, 17 bp, Artificial Sequence
  Synthetic Polynucleotide
tgcagtgacacaaaagt

SEQ ID NO: 6449 - DNA, 17 bp, Artificial Sequence
  Synthetic Polynucleotide
ggtattgaaaccctggc

SEQ ID NO: 6450 - DNA, 19 bp, Artificial Sequence
  Synthetic Polynucleotide
gcatctcctacctactttt

SEQ ID NO: 6451 - DNA, 18 bp, Artificial Sequence
  Synthetic Polynucleotide
atcccaccttagcttatg

SEQ ID NO: 6452 - DNA, 20 bp, Artificial Sequence
  Synthetic Polynucleotide
gtggctgtggtattttatat

SEQ ID NO: 6453 - DNA, 20 bp, Artificial Sequence
  Synthetic Polynucleotide
ctctctgaaatggaaaacaa

SEQ ID NO: 6454 - DNA, 17 bp, Artificial Sequence
  Synthetic Polynucleotide
aggtccagaacattcct

SEQ ID NO: 6455 - DNA, 19 bp, Artificial Sequence
  Synthetic Polynucleotide
cgaatcgagtatgggctcg

SEQ ID NO: 6456 - DNA, 18 bp, Artificial Sequence
  Synthetic Polynucleotide
aacggattgcggtacaac

SEQ ID NO: 6457 - DNA, 19 bp, Artificial Sequence
  Synthetic Polynucleotide
gatcaagttcaatcgaacg

SEQ ID NO: 6458 - DNA, 18 bp, Artificial Sequence
  Synthetic Polynucleotide
ccaggtctcattggattc

SEQ ID NO: 6459 - DNA, 19 bp, Artificial Sequence
  Synthetic Polynucleotide
gaaaagttacactccatgg

SEQ ID NO: 6460 - DNA, 20 bp, Artificial Sequence
  Synthetic Polynucleotide
tctgctaaaagttcatgtga

SEQ ID NO: 6461 - DNA, 19 bp, Artificial Sequence
  Synthetic Polynucleotide
agtgagtacatcattccta

SEQ ID NO: 6462 - DNA, 18 bp, Artificial Sequence
  Synthetic Polynucleotide
tggatctagcaaacagtt

SEQ ID NO: 6463 - DNA, 19 bp, Artificial Sequence
  Synthetic Polynucleotide
ctacttacgactctggtca

SEQ ID NO: 6464 - DNA, 19 bp, Artificial Sequence
  Synthetic Polynucleotide
gagaaagtgagcgtcaatt

SEQ ID NO: 6465 - DNA, 20 bp, Artificial Sequence
  Synthetic Polynucleotide
ctctgtgcctaaatatagac

SEQ ID NO: 6466 - DNA, 19 bp, Artificial Sequence
  Synthetic Polynucleotide
caagaagcgaaaagagaac

SEQ ID NO: 6467 - DNA, 20 bp, Artificial Sequence
  Synthetic Polynucleotide
ttttatcaaaagacacgagg

SEQ ID NO: 6468 - DNA, 18 bp, Artificial Sequence
  Synthetic Polynucleotide
acattcctccatcgtcat

SEQ ID NO: 6469 - DNA, 18 bp, Artificial Sequence
  Synthetic Polynucleotide
caattgggcgacaaagct

SEQ ID NO: 6470 - DNA, 18 bp, Artificial Sequence
  Synthetic Polynucleotide
acaatagcatcattcggg

SEQ ID NO: 6471 - DNA, 17 bp, Artificial Sequence
  Synthetic Polynucleotide
cggaaccttacggctgc

SEQ ID NO: 6472 - DNA, 17 bp, Artificial Sequence
  Synthetic Polynucleotide
gctgaaggaaaaccagt

SEQ ID NO: 6473 - DNA, 17 bp, Artificial Sequence
  Synthetic Polynucleotide
gcggatattcggtcaga

SEQ ID NO: 6474 - DNA, 17 bp, Artificial Sequence
  Synthetic Polynucleotide
cctatcccaccttacct

SEQ ID NO: 6475 - DNA, 20 bp, Artificial Sequence
  Synthetic Polynucleotide
cacactgtactaaggatagt

SEQ ID NO: 6476 - DNA, 18 bp, Artificial Sequence
  Synthetic Polynucleotide
taagggaactaagtggat

SEQ ID NO: 6477 - DNA, 19 bp, Artificial Sequence
  Synthetic Polynucleotide
tggacgctactcaagctgt

SEQ ID NO: 6478 - DNA, 17 bp, Artificial Sequence
  Synthetic Polynucleotide
agcaacatccatctcac

SEQ ID NO: 6479 - DNA, 17 bp, Artificial Sequence
  Synthetic Polynucleotide
agtccaacgagcccatg

SEQ ID NO: 6480 - DNA, 20 bp, Artificial Sequence
  Synthetic Polynucleotide
gtggctgtggtattttatat

SEQ ID NO: 6481 - DNA, 20 bp, Artificial Sequence
  Synthetic Polynucleotide
tgtcgcatcttttcggcagt

SEQ ID NO: 6482 - DNA, 17 bp, Artificial Sequence
  Synthetic Polynucleotide
gctaaggtgggatagga

SEQ ID NO: 6483 - DNA, 20 bp, Artificial Sequence
  Synthetic Polynucleotide
ccgttcttaacgtcaaagca

SEQ ID NO: 6484 - DNA, 17 bp, Artificial Sequence
  Synthetic Polynucleotide
aaccattcacgagcaca

SEQ ID NO: 6485 - DNA, 19 bp, Artificial Sequence
  Synthetic Polynucleotide
tccatcgtcaaaggcatct

SEQ ID NO: 6486 - DNA, 18 bp, Artificial Sequence
  Synthetic Polynucleotide
aggtgtttagtaagaccg

SEQ ID NO: 6487 - DNA, 20 bp, Artificial Sequence
  Synthetic Polynucleotide
tcatttactgacaagcatac

SEQ ID NO: 6488 - DNA, 17 bp, Artificial Sequence
  Synthetic Polynucleotide
tcgagttttcaatcacc

SEQ ID NO: 6489 - DNA, 19 bp, Artificial Sequence
  Synthetic Polynucleotide
gcaaggcagaagaaataat

SEQ ID NO: 6490 - DNA, 19 bp, Artificial Sequence
  Synthetic Polynucleotide
acgttttacatttgtggta

SEQ ID NO: 6491 - DNA, 20 bp, Artificial Sequence
  Synthetic Polynucleotide
ccaggtgttaatctttaagg

SEQ ID NO: 6492 - DNA, 18 bp, Artificial Sequence
  Synthetic Polynucleotide
ccgcccgtaatagcagac

SEQ ID NO: 6493 - DNA, 17 bp, Artificial Sequence
  Synthetic Polynucleotide
acatgtcaaccaacgca

SEQ ID NO: 6494 - DNA, 19 bp, Artificial Sequence
  Synthetic Polynucleotide
cttaatggcaacatacaga

SEQ ID NO: 6495 - DNA, 18 bp, Artificial Sequence
  Synthetic Polynucleotide
ctctaattggaaagcacc

SEQ ID NO: 6496 - DNA, 20 bp, Artificial Sequence
  Synthetic Polynucleotide
agagaagatcgcatactaat

SEQ ID NO: 6497 - DNA, 17 bp, Artificial Sequence
  Synthetic Polynucleotide
tgcatctactgaaaccc

SEQ ID NO: 6498 - DNA, 19 bp, Artificial Sequence
  Synthetic Polynucleotide
tgttataagcactctcaga

SEQ ID NO: 6499 - DNA, 18 bp, Artificial Sequence
  Synthetic Polynucleotide
ttcgcatacaagagcttt

SEQ ID NO: 6500 - DNA, 20 bp, Artificial Sequence
  Synthetic Polynucleotide
tctcagaacttgatttggaa

SEQ ID NO: 6501 - DNA, 19 bp, Artificial Sequence
  Synthetic Polynucleotide
ctttcatacttcgaaacca

SEQ ID NO: 6502 - DNA, 18 bp, Artificial Sequence
  Synthetic Polynucleotide
taacattcagaagcccca

SEQ ID NO: 6503 - DNA, 20 bp, Artificial Sequence
  Synthetic Polynucleotide
ttagagcccagagaaggttt

SEQ ID NO: 6504 - DNA, 18 bp, Artificial Sequence
  Synthetic Polynucleotide
gcagcaaaattcccgaat

SEQ ID NO: 6505 - DNA, 19 bp, Artificial Sequence
  Synthetic Polynucleotide
gatcttcttggtcaggaag

SEQ ID NO: 6506 - DNA, 17 bp, Artificial Sequence
  Synthetic Polynucleotide
tatctctcattccacgt

SEQ ID NO: 6507 - DNA, 19 bp, Artificial Sequence
  Synthetic Polynucleotide
atatggtcaaggtgttgaa

SEQ ID NO: 6508 - DNA, 18 bp, Artificial Sequence
  Synthetic Polynucleotide
aagcggtagaaactgaac

SEQ ID NO: 6509 - DNA, 20 bp, Artificial Sequence
  Synthetic Polynucleotide
aagaaatacaagtgttgctg

SEQ ID NO: 6510 - DNA, 20 bp, Artificial Sequence
  Synthetic Polynucleotide
tgaattgtcattgctcccac

SEQ ID NO: 6511 - DNA, 19 bp, Artificial Sequence
  Synthetic Polynucleotide
caccacacaacttagaaac

SEQ ID NO: 6512 - DNA, 18 bp, Artificial Sequence
  Synthetic Polynucleotide
atcgttcgcagatgcagc

SEQ ID NO: 6513 - DNA, 18 bp, Artificial Sequence
  Synthetic Polynucleotide
gaaaacgtaaagcgtcaa

SEQ ID NO: 6514 - DNA, 18 bp, Artificial Sequence
  Synthetic Polynucleotide
acaaagtgatgccctgtt

SEQ ID NO: 6515 - DNA, 20 bp, Artificial Sequence
  Synthetic Polynucleotide
attagaactgattgttgcca

SEQ ID NO: 6516 - DNA, 19 bp, Artificial Sequence
  Synthetic Polynucleotide
ttacctcgccgaaaccctt

SEQ ID NO: 6517 - DNA, 19 bp, Artificial Sequence
  Synthetic Polynucleotide
tgctcaatagaggctatcg

SEQ ID NO: 6518 - DNA, 19 bp, Artificial Sequence
  Synthetic Polynucleotide
gagcggtatcgtctatatt

SEQ ID NO: 6519 - DNA, 20 bp, Artificial Sequence
  Synthetic Polynucleotide
ccagcgtattataacatctc

SEQ ID NO: 6520 - DNA, 18 bp, Artificial Sequence
  Synthetic Polynucleotide
attggtgtcgcatgtcta

SEQ ID NO: 6521 - DNA, 19 bp, Artificial Sequence
  Synthetic Polynucleotide
ttgcacattcctcgtgatg

SEQ ID NO: 6522 - DNA, 18 bp, Artificial Sequence
  Synthetic Polynucleotide
tgctccgtatcatcagag

SEQ ID NO: 6523 - DNA, 20 bp, Artificial Sequence
  Synthetic Polynucleotide
gtccatccgtctcttcgtct

SEQ ID NO: 6524 - DNA, 19 bp, Artificial Sequence
  Synthetic Polynucleotide
gccagtccataataggaat

SEQ ID NO: 6525 - DNA, 20 bp, Artificial Sequence
  Synthetic Polynucleotide
aacccgattgaaaatagttg

SEQ ID NO: 6526 - DNA, 19 bp, Artificial Sequence
  Synthetic Polynucleotide
tattcacagcgtaatttcg

SEQ ID NO: 6527 - DNA, 19 bp, Artificial Sequence
  Synthetic Polynucleotide
ttcattttagcactcgaaa

SEQ ID NO: 6528 - DNA, 18 bp, Artificial Sequence
  Synthetic Polynucleotide
aagacttcgccacattgc

SEQ ID NO: 6529 - DNA, 17 bp, Artificial Sequence
  Synthetic Polynucleotide
gtccgtcaatctccaga

SEQ ID NO: 6530 - DNA, 19 bp, Artificial Sequence
  Synthetic Polynucleotide
gctcccataaggctatcga

SEQ ID NO: 6531 - DNA, 18 bp, Artificial Sequence
  Synthetic Polynucleotide
caggcccgataatttcca

SEQ ID NO: 6532 - DNA, 19 bp, Artificial Sequence
  Synthetic Polynucleotide
gagcttccgatcatctatc

SEQ ID NO: 6533 - DNA, 20 bp, Artificial Sequence
  Synthetic Polynucleotide
gaaacgtcacagtaaagccg

SEQ ID NO: 6534 - DNA, 20 bp, Artificial Sequence
  Synthetic Polynucleotide
ggaagaatacttaagcacaa

SEQ ID NO: 6535 - DNA, 19 bp, Artificial Sequence
  Synthetic Polynucleotide
tgagtacccattatgtagg

SEQ ID NO: 6536 - DNA, 20 bp, Artificial Sequence
  Synthetic Polynucleotide
tcttaacgaaggagcatacg

SEQ ID NO: 6537 - DNA, 20 bp, Artificial Sequence
  Synthetic Polynucleotide
tcggagcagatattcatatg

SEQ ID NO: 6538 - DNA, 17 bp, Artificial Sequence
  Synthetic Polynucleotide
aatgtccccgtgtcatc

SEQ ID NO: 6539 - DNA, 18 bp, Artificial Sequence
  Synthetic Polynucleotide
tccgcttcatcaatatca

SEQ ID NO: 6540 - DNA, 18 bp, Artificial Sequence
  Synthetic Polynucleotide
tatcatagcgaataccgg

SEQ ID NO: 6541 - DNA, 17 bp, Artificial Sequence
  Synthetic Polynucleotide
gattcccgatggagaat

SEQ ID NO: 6542 - DNA, 18 bp, Artificial Sequence
  Synthetic Polynucleotide
gaacatgaactcatcggc

SEQ ID NO: 6543 - DNA, 18 bp, Artificial Sequence
  Synthetic Polynucleotide
gatattttgacctggagc

SEQ ID NO: 6544 - DNA, 18 bp, Artificial Sequence
  Synthetic Polynucleotide
tcgtgaaataattggcat

SEQ ID NO: 6545 - DNA, 20 bp, Artificial Sequence
  Synthetic Polynucleotide
cagttcctctgtcagtttca

SEQ ID NO: 6546 - DNA, 19 bp, Artificial Sequence
  Synthetic Polynucleotide
cagcgacccggcagtatat

SEQ ID NO: 6547 - DNA, 19 bp, Artificial Sequence
  Synthetic Polynucleotide
gtatcccttaacaaccgat

SEQ ID NO: 6548 - DNA, 20 bp, Artificial Sequence
  Synthetic Polynucleotide
tctacagctactaccagtgg

SEQ ID NO: 6549 - DNA, 17 bp, Artificial Sequence
  Synthetic Polynucleotide
ccaacgagcacatatgc

SEQ ID NO: 6550 - DNA, 20 bp, Artificial Sequence
  Synthetic Polynucleotide
acacacacatacacaactaa

SEQ ID NO: 6551 - DNA, 19 bp, Artificial Sequence
  Synthetic Polynucleotide
ctcttttaacgtccataga

SEQ ID NO: 6552 - DNA, 18 bp, Artificial Sequence
  Synthetic Polynucleotide
gagcgtaatgtctctgta

SEQ ID NO: 6553 - DNA, 18 bp, Artificial Sequence
  Synthetic Polynucleotide
ctcccagcctgacctctc

SEQ ID NO: 6554 - DNA, 17 bp, Artificial Sequence
  Synthetic Polynucleotide
aagaaagagttgcagcg

SEQ ID NO: 6555 - DNA, 18 bp, Artificial Sequence
  Synthetic Polynucleotide
aggcataaaatcaccgcg

SEQ ID NO: 6556 - DNA, 20 bp, Artificial Sequence
  Synthetic Polynucleotide
acagtcggcacttttgtggt

SEQ ID NO: 6557 - DNA, 19 bp, Artificial Sequence
  Synthetic Polynucleotide
gttcattcaaccaccaata

SEQ ID NO: 6558 - DNA, 17 bp, Artificial Sequence
  Synthetic Polynucleotide
ccactaagcagtcttgg

SEQ ID NO: 6559 - DNA, 17 bp, Artificial Sequence
  Synthetic Polynucleotide
tcacattatcccaccca

SEQ ID NO: 6560 - DNA, 20 bp, Artificial Sequence
  Synthetic Polynucleotide
gacgaagatcaacaattttg

SEQ ID NO: 6561 - DNA, 20 bp, Artificial Sequence
  Synthetic Polynucleotide
gattcattgaaaggtaacgt

SEQ ID NO: 6562 - DNA, 19 bp, Artificial Sequence
  Synthetic Polynucleotide
atattacttgcagcattgc

SEQ ID NO: 6563 - DNA, 20 bp, Artificial Sequence
  Synthetic Polynucleotide
tgaaaacccaccgaacattt

SEQ ID NO: 6564 - DNA, 19 bp, Artificial Sequence
  Synthetic Polynucleotide
cagccctagatataatcca

SEQ ID NO: 6565 - DNA, 17 bp, Artificial Sequence
  Synthetic Polynucleotide
gagggattgacagtgga

SEQ ID NO: 6566 - DNA, 20 bp, Artificial Sequence
  Synthetic Polynucleotide
aatcactattccgttcatta

SEQ ID NO: 6567 - DNA, 19 bp, Artificial Sequence
  Synthetic Polynucleotide
caatgggagacaacaaatg

SEQ ID NO: 6568 - DNA, 18 bp, Artificial Sequence
  Synthetic Polynucleotide
tgttgcgtttcgaatcta

SEQ ID NO: 6569 - DNA, 20 bp, Artificial Sequence
  Synthetic Polynucleotide
aaacctcaactttcgtcatc

SEQ ID NO: 6570 - DNA, 18 bp, Artificial Sequence
  Synthetic Polynucleotide
attccgagcaccatcttt

SEQ ID NO: 6571 - DNA, 18 bp, Artificial Sequence
  Synthetic Polynucleotide
gcctatcacgggttcaac

SEQ ID NO: 6572 - DNA, 20 bp, Artificial Sequence
  Synthetic Polynucleotide
tgtaattaacattgcgtctt

SEQ ID NO: 6573 - DNA, 20 bp, Artificial Sequence
  Synthetic Polynucleotide
tgcctttctgaaaagacact

SEQ ID NO: 6574 - DNA, 20 bp, Artificial Sequence
  Synthetic Polynucleotide
ttcctgttcttacgggactc

SEQ ID NO: 6575 - DNA, 19 bp, Artificial Sequence
  Synthetic Polynucleotide
gttcatcgggacttggatt

SEQ ID NO: 6576 - DNA, 18 bp, Artificial Sequence
  Synthetic Polynucleotide
tgagaccctaaatgtggc

SEQ ID NO: 6577 - DNA, 20 bp, Artificial Sequence
  Synthetic Polynucleotide
acactttctgtaagtcgttg

SEQ ID NO: 6578 - DNA, 17 bp, Artificial Sequence
  Synthetic Polynucleotide
gctttgagccatgagta

SEQ ID NO: 6579 - DNA, 19 bp, Artificial Sequence
  Synthetic Polynucleotide
aattaacgtcggtcggtca

SEQ ID NO: 6580 - DNA, 19 bp, Artificial Sequence
  Synthetic Polynucleotide
ggaaacttgcatcgtatta

SEQ ID NO: 6581 - DNA, 18 bp, Artificial Sequence
  Synthetic Polynucleotide
gttcaccagattcttcac

SEQ ID NO: 6582 - DNA, 19 bp, Artificial Sequence
  Synthetic Polynucleotide
cgttatttcacactctcat

SEQ ID NO: 6583 - DNA, 20 bp, Artificial Sequence
  Synthetic Polynucleotide
agcgagacttaaccaaatac

SEQ ID NO: 6584 - DNA, 17 bp, Artificial Sequence
  Synthetic Polynucleotide
taatgtgcagccatagc

SEQ ID NO: 6585 - DNA, 20 bp, Artificial Sequence
  Synthetic Polynucleotide
ccatatatcacacttagcac

SEQ ID NO: 6586 - DNA, 17 bp, Artificial Sequence
  Synthetic Polynucleotide
aagttttacattggcgc

SEQ ID NO: 6587 - DNA, 17 bp, Artificial Sequence
  Synthetic Polynucleotide
cagtaggaaggtcaaga

SEQ ID NO: 6588 - DNA, 20 bp, Artificial Sequence
  Synthetic Polynucleotide
tataaatgtttggcgtggat

SEQ ID NO: 6589 - DNA, 18 bp, Artificial Sequence
  Synthetic Polynucleotide
ggcgtttctcttaattgc

SEQ ID NO: 6590 - DNA, 17 bp, Artificial Sequence
  Synthetic Polynucleotide
cttgagaagccttagcg

SEQ ID NO: 6591 - DNA, 18 bp, Artificial Sequence
  Synthetic Polynucleotide
gtcctaattgtagcagcg

SEQ ID NO: 6592 - DNA, 18 bp, Artificial Sequence
  Synthetic Polynucleotide
tcgataaaggtcactaga

SEQ ID NO: 6593 - DNA, 19 bp, Artificial Sequence
  Synthetic Polynucleotide
cctccaattttctaaacca

SEQ ID NO: 6594 - DNA, 20 bp, Artificial Sequence
  Synthetic Polynucleotide
ttgatgagttaaattgggag

SEQ ID NO: 6595 - DNA, 18 bp, Artificial Sequence
  Synthetic Polynucleotide
cagccttagactttccta

SEQ ID NO: 6596 - DNA, 19 bp, Artificial Sequence
  Synthetic Polynucleotide
tttctcaaggggcgaaaca

SEQ ID NO: 6597 - DNA, 20 bp, Artificial Sequence
  Synthetic Polynucleotide
tcggctagacattttatgag

SEQ ID NO: 6598 - DNA, 17 bp, Artificial Sequence
  Synthetic Polynucleotide
gcagaggattccagcaa

SEQ ID NO: 6599 - DNA, 18 bp, Artificial Sequence
  Synthetic Polynucleotide
aatttgtatcggcaaacg

SEQ ID NO: 6600 - DNA, 18 bp, Artificial Sequence
  Synthetic Polynucleotide
cttgtcgggtcaaaatct

SEQ ID NO: 6601 - DNA, 18 bp, Artificial Sequence
  Synthetic Polynucleotide
ttcacagtatgcacatga

SEQ ID NO: 6602 - DNA, 20 bp, Artificial Sequence
  Synthetic Polynucleotide
aacatcttgtcggatcaatc

SEQ ID NO: 6603 - DNA, 18 bp, Artificial Sequence
  Synthetic Polynucleotide
aaccaagtgggcaaataa

SEQ ID NO: 6604 - DNA, 18 bp, Artificial Sequence
  Synthetic Polynucleotide
cacagccacgggaaataa

SEQ ID NO: 6605 - DNA, 20 bp, Artificial Sequence
  Synthetic Polynucleotide
ccctggtaaataacttacgt

SEQ ID NO: 6606 - DNA, 20 bp, Artificial Sequence
  Synthetic Polynucleotide
taatccaacctttctcacgg

SEQ ID NO: 6607 - DNA, 20 bp, Artificial Sequence
  Synthetic Polynucleotide
agcgataattgaattctgac

SEQ ID NO: 6608 - DNA, 17 bp, Artificial Sequence
  Synthetic Polynucleotide
gccagaccatcacgtcg

SEQ ID NO: 6609 - DNA, 17 bp, Artificial Sequence
  Synthetic Polynucleotide
cgatagtcggagaacgc

SEQ ID NO: 6610 - DNA, 20 bp, Artificial Sequence
  Synthetic Polynucleotide
taaggacagcaataactctc

SEQ ID NO: 6611 - DNA, 17 bp, Artificial Sequence
  Synthetic Polynucleotide
tcaatcactcgttcgat

SEQ ID NO: 6612 - DNA, 20 bp, Artificial Sequence
  Synthetic Polynucleotide
tgttcatgctagtacgtaac

SEQ ID NO: 6613 - DNA, 20 bp, Artificial Sequence
  Synthetic Polynucleotide
tactgatagtgagcgatagt

SEQ ID NO: 6614 - DNA, 19 bp, Artificial Sequence
  Synthetic Polynucleotide
tggtatagcaacggcaata

SEQ ID NO: 6615 - DNA, 19 bp, Artificial Sequence
  Synthetic Polynucleotide
atatcaactgctccatagt

SEQ ID NO: 6616 - DNA, 20 bp, Artificial Sequence
  Synthetic Polynucleotide
agaaacagcagtacaatacg

SEQ ID NO: 6617 - DNA, 20 bp, Artificial Sequence
  Synthetic Polynucleotide
ttatgtaaccttcgagcatc

SEQ ID NO: 6618 - DNA, 20 bp, Artificial Sequence
  Synthetic Polynucleotide
tggtaacctatcaacatcac

SEQ ID NO: 6619 - DNA, 20 bp, Artificial Sequence
  Synthetic Polynucleotide
tatcaaagtacaccgtattt

SEQ ID NO: 6620 - DNA, 19 bp, Artificial Sequence
  Synthetic Polynucleotide
tgaggcattttagagatcc

SEQ ID NO: 6621 - DNA, 19 bp, Artificial Sequence
  Synthetic Polynucleotide
ggcacttaacatttcgtaa

SEQ ID NO: 6622 - DNA, 20 bp, Artificial Sequence
  Synthetic Polynucleotide
gacattgttattccatttcg

SEQ ID NO: 6623 - DNA, 17 bp, Artificial Sequence
  Synthetic Polynucleotide
tcttgtttgaggaacgt

SEQ ID NO: 6624 - DNA, 17 bp, Artificial Sequence
  Synthetic Polynucleotide
tccattacattctcgga

SEQ ID NO: 6625 - DNA, 17 bp, Artificial Sequence
  Synthetic Polynucleotide
tactggtcaaggaaggt

SEQ ID NO: 6626 - DNA, 20 bp, Artificial Sequence
  Synthetic Polynucleotide
tccgtaacagtcaatagcct

SEQ ID NO: 6627 - DNA, 20 bp, Artificial Sequence
  Synthetic Polynucleotide
gccatcatttgtgaaaacat

SEQ ID NO: 6628 - DNA, 20 bp, Artificial Sequence
  Synthetic Polynucleotide
ttatgcttggaagtccctag

SEQ ID NO: 6629 - DNA, 17 bp, Artificial Sequence
  Synthetic Polynucleotide
aacacaccgacgctcaa

SEQ ID NO: 6630 - DNA, 19 bp, Artificial Sequence
  Synthetic Polynucleotide
aatcacgaacacgatttat

SEQ ID NO: 6631 - DNA, 20 bp, Artificial Sequence
  Synthetic Polynucleotide
aagtaagatccggctgcaac

SEQ ID NO: 6632 - DNA, 17 bp, Artificial Sequence
  Synthetic Polynucleotide
cgaccgaagtcttttgc

SEQ ID NO: 6633 - DNA, 19 bp, Artificial Sequence
  Synthetic Polynucleotide
caaaacggcaacaattaac

SEQ ID NO: 6634 - DNA, 18 bp, Artificial Sequence
  Synthetic Polynucleotide
tccattgtttcctcgatt

SEQ ID NO: 6635 - DNA, 19 bp, Artificial Sequence
  Synthetic Polynucleotide
acagcaacgtaaagaagct

SEQ ID NO: 6636 - DNA, 18 bp, Artificial Sequence
  Synthetic Polynucleotide
agctgctccctctcgaac

SEQ ID NO: 6637 - DNA, 19 bp, Artificial Sequence
  Synthetic Polynucleotide
gcatttagtatcgacacct

SEQ ID NO: 6638 - DNA, 20 bp, Artificial Sequence
  Synthetic Polynucleotide
catcgccattcaggcacatc

SEQ ID NO: 6639 - DNA, 18 bp, Artificial Sequence
  Synthetic Polynucleotide
tgatcgaagtccaattgc

SEQ ID NO: 6640 - DNA, 18 bp, Artificial Sequence
  Synthetic Polynucleotide
cctgattttcccactaca

SEQ ID NO: 6641 - DNA, 18 bp, Artificial Sequence
  Synthetic Polynucleotide
aggtccgaaggtatgccc

SEQ ID NO: 6642 - DNA, 17 bp, Artificial Sequence
  Synthetic Polynucleotide
gtcgccatctccattct

SEQ ID NO: 6643 - DNA, 17 bp, Artificial Sequence
  Synthetic Polynucleotide
aagcacacacttctgat

SEQ ID NO: 6644 - DNA, 20 bp, Artificial Sequence
  Synthetic Polynucleotide
ataaaggggtagtacgcacg

SEQ ID NO: 6645 - DNA, 20 bp, Artificial Sequence
  Synthetic Polynucleotide
ttagtatcgaatccaaccgt

SEQ ID NO: 6646 - DNA, 17 bp, Artificial Sequence
  Synthetic Polynucleotide
tccctcaacaaagccaa

SEQ ID NO: 6647 - DNA, 17 bp, Artificial Sequence
  Synthetic Polynucleotide
tccaacccgtagcaact

SEQ ID NO: 6648 - DNA, 19 bp, Artificial Sequence
  Synthetic Polynucleotide
tatacacacttagattccg

SEQ ID NO: 6649 - DNA, 19 bp, Artificial Sequence
  Synthetic Polynucleotide
cttagaactccagaactct

SEQ ID NO: 6650 - DNA, 20 bp, Artificial Sequence
  Synthetic Polynucleotide
cattagaaccaactgtgaat

SEQ ID NO: 6651 - DNA, 19 bp, Artificial Sequence
  Synthetic Polynucleotide
cacgaatttgagtcagata

SEQ ID NO: 6652 - DNA, 20 bp, Artificial Sequence
  Synthetic Polynucleotide
cgtaattcaggtacactcac

SEQ ID NO: 6653 - DNA, 17 bp, Artificial Sequence
  Synthetic Polynucleotide
gaactatcgcaacgaca

SEQ ID NO: 6654 - DNA, 19 bp, Artificial Sequence
  Synthetic Polynucleotide
tcagctcatcaaaatccac

SEQ ID NO: 6655 - DNA, 18 bp, Artificial Sequence
  Synthetic Polynucleotide
aacaacagtggaaactct

SEQ ID NO: 6656 - DNA, 18 bp, Artificial Sequence
  Synthetic Polynucleotide
atggctctatctgcatcc

SEQ ID NO: 6657 - DNA, 20 bp, Artificial Sequence
  Synthetic Polynucleotide
tagttattttgaaatgcgtt

SEQ ID NO: 6658 - DNA, 19 bp, Artificial Sequence
  Synthetic Polynucleotide
gcgctgtatttattcactc

SEQ ID NO: 6659 - DNA, 17 bp, Artificial Sequence
  Synthetic Polynucleotide
cgctgaaaagacgtttt

SEQ ID NO: 6660 - DNA, 19 bp, Artificial Sequence
  Synthetic Polynucleotide
tgactaagtgtttgaacca

SEQ ID NO: 6661 - DNA, 17 bp, Artificial Sequence
  Synthetic Polynucleotide
ggctgaagctgtttcgc

SEQ ID NO: 6662 - DNA, 17 bp, Artificial Sequence
  Synthetic Polynucleotide
gtccctccctcgatggt

SEQ ID NO: 6663 - DNA, 19 bp, Artificial Sequence
  Synthetic Polynucleotide
gttcatgccgttgtattgg

SEQ ID NO: 6664 - DNA, 18 bp, Artificial Sequence
  Synthetic Polynucleotide
tagaattggcagtcacgc

SEQ ID NO: 6665 - DNA, 17 bp, Artificial Sequence
  Synthetic Polynucleotide
agcaagttcccatgtac

SEQ ID NO: 6666 - DNA, 18 bp, Artificial Sequence
  Synthetic Polynucleotide
tttggtctggaactcaga

SEQ ID NO: 6667 - DNA, 20 bp, Artificial Sequence
  Synthetic Polynucleotide
atcattgttctcacgaagac

SEQ ID NO: 6668 - DNA, 20 bp, Artificial Sequence
  Synthetic Polynucleotide
caaggtcattgaacaatctg

SEQ ID NO: 6669 - DNA, 19 bp, Artificial Sequence
  Synthetic Polynucleotide
tatctgatgtcactaggtg

SEQ ID NO: 6670 - DNA, 18 bp, Artificial Sequence
  Synthetic Polynucleotide
accaatcgttgctgtatc

SEQ ID NO: 6671 - DNA, 18 bp, Artificial Sequence
  Synthetic Polynucleotide
gttggactcttcttggcc

SEQ ID NO: 6672 - DNA, 19 bp, Artificial Sequence
  Synthetic Polynucleotide
tttataccaagttcgctta

SEQ ID NO: 6673 - DNA, 19 bp, Artificial Sequence
  Synthetic Polynucleotide
agtttaaggccccgtcaac

SEQ ID NO: 6674 - DNA, 18 bp, Artificial Sequence
  Synthetic Polynucleotide
cgctcattggctttatct

SEQ ID NO: 6675 - DNA, 18 bp, Artificial Sequence
  Synthetic Polynucleotide
gtacttatctgcacacgt

SEQ ID NO: 6676 - DNA, 20 bp, Artificial Sequence
  Synthetic Polynucleotide
aaatccctcgatctcttcaa

SEQ ID NO: 6677 - DNA, 18 bp, Artificial Sequence
  Synthetic Polynucleotide
agtcccaaatgtatccga

SEQ ID NO: 6678 - DNA, 20 bp, Artificial Sequence
  Synthetic Polynucleotide
gctacacccgaattgaatat

SEQ ID NO: 6679 - DNA, 18 bp, Artificial Sequence
  Synthetic Polynucleotide
tcaatcctatgatggtcg

SEQ ID NO: 6680 - DNA, 20 bp, Artificial Sequence
  Synthetic Polynucleotide
ggtattcccgcttaaagtat

SEQ ID NO: 6681 - DNA, 19 bp, Artificial Sequence
  Synthetic Polynucleotide
agctaacatgacaagtttg

SEQ ID NO: 6682 - DNA, 17 bp, Artificial Sequence
  Synthetic Polynucleotide
agccccaaatatacccg

SEQ ID NO: 6683 - DNA, 17 bp, Artificial Sequence
  Synthetic Polynucleotide
cctgctggactatgtag

SEQ ID NO: 6684 - DNA, 17 bp, Artificial Sequence
  Synthetic Polynucleotide
ccttgcgtccggtcttc

SEQ ID NO: 6685 - DNA, 18 bp, Artificial Sequence
  Synthetic Polynucleotide
aagtaaaggcaacatcca

SEQ ID NO: 6686 - DNA, 17 bp, Artificial Sequence
  Synthetic Polynucleotide
gctgaaattgctgctgg

SEQ ID NO: 6687 - DNA, 18 bp, Artificial Sequence
  Synthetic Polynucleotide
gcaggtgttacagtcccg

SEQ ID NO: 6688 - DNA, 17 bp, Artificial Sequence
  Synthetic Polynucleotide
ctgccacaggattttca

SEQ ID NO: 6689 - DNA, 17 bp, Artificial Sequence
  Synthetic Polynucleotide
tgcttcctcttgcaaaa

SEQ ID NO: 6690 - DNA, 20 bp, Artificial Sequence
  Synthetic Polynucleotide
cacttagtgatgagtaccct

SEQ ID NO: 6691 - DNA, 18 bp, Artificial Sequence
  Synthetic Polynucleotide
ccgctttccttgtcatga

SEQ ID NO: 6692 - DNA, 20 bp, Artificial Sequence
  Synthetic Polynucleotide
tcttggggaaacaataccaa

SEQ ID NO: 6693 - DNA, 20 bp, Artificial Sequence
  Synthetic Polynucleotide
tactagacactccaacaacc

SEQ ID NO: 6694 - DNA, 18 bp, Artificial Sequence
  Synthetic Polynucleotide
agccctgattgtgtacca

SEQ ID NO: 6695 - DNA, 20 bp, Artificial Sequence
  Synthetic Polynucleotide
gctgaagtattcgaccttgc

SEQ ID NO: 6696 - DNA, 20 bp, Artificial Sequence
  Synthetic Polynucleotide
gttcacaaatcttgcgaatg

SEQ ID NO: 6697 - DNA, 19 bp, Artificial Sequence
  Synthetic Polynucleotide
ggtgatgaagagaaaatga

SEQ ID NO: 6698 - DNA, 17 bp, Artificial Sequence
  Synthetic Polynucleotide
agcaccatcatttggtc

SEQ ID NO: 6699 - DNA, 18 bp, Artificial Sequence
  Synthetic Polynucleotide
gcctcacatatcatttga

SEQ ID NO: 6700 - DNA, 20 bp, Artificial Sequence
  Synthetic Polynucleotide
gtagctgttattaaactccc

SEQ ID NO: 6701 - DNA, 18 bp, Artificial Sequence
  Synthetic Polynucleotide
tgagcttcctacaagcca

SEQ ID NO: 6702 - DNA, 20 bp, Artificial Sequence
  Synthetic Polynucleotide
cctatcatcccacagaaact

SEQ ID NO: 6703 - DNA, 17 bp, Artificial Sequence
  Synthetic Polynucleotide
ttctactagagtcccga

SEQ ID NO: 6704 - DNA, 20 bp, Artificial Sequence
  Synthetic Polynucleotide
taaccagttctacctctcct

SEQ ID NO: 6705 - DNA, 20 bp, Artificial Sequence
  Synthetic Polynucleotide
gtctactccagttttaactc

SEQ ID NO: 6706 - DNA, 20 bp, Artificial Sequence
  Synthetic Polynucleotide
tcaaagccaacaaagtccta

SEQ ID NO: 6707 - DNA, 18 bp, Artificial Sequence
  Synthetic Polynucleotide
tacaacaatatgcttcca

SEQ ID NO: 6708 - DNA, 18 bp, Artificial Sequence
  Synthetic Polynucleotide
gtctgtcaaagtccactt

SEQ ID NO: 6709 - DNA, 17 bp, Artificial Sequence
  Synthetic Polynucleotide
acgtttccatccaagcc

SEQ ID NO: 6710 - DNA, 20 bp, Artificial Sequence
  Synthetic Polynucleotide
ggaatgtgggtgatgatgga

SEQ ID NO: 6711 - DNA, 17 bp, Artificial Sequence
  Synthetic Polynucleotide
aaaccatatcgtggcat

SEQ ID NO: 6712 - DNA, 17 bp, Artificial Sequence
  Synthetic Polynucleotide
atggtttggtgcattga

SEQ ID NO: 6713 - DNA, 17 bp, Artificial Sequence
  Synthetic Polynucleotide
ttccactgtgtgtctct

SEQ ID NO: 6714 - DNA, 17 bp, Artificial Sequence
  Synthetic Polynucleotide
tggtatgagggagtgag

SEQ ID NO: 6715 - DNA, 17 bp, Artificial Sequence
  Synthetic Polynucleotide
gctgtctcagctatgta

SEQ ID NO: 6716 - DNA, 17 bp, Artificial Sequence
  Synthetic Polynucleotide
ggagctaaagtttgcgt

SEQ ID NO: 6717 - DNA, 17 bp, Artificial Sequence
  Synthetic Polynucleotide
catccgttgctgtgtgc

SEQ ID NO: 6718 - DNA, 18 bp, Artificial Sequence
  Synthetic Polynucleotide
taaatgctgtgcttagaa

SEQ ID NO: 6719 - DNA, 20 bp, Artificial Sequence
  Synthetic Polynucleotide
agctgtctctgcaatatatg

SEQ ID NO: 6720 - DNA, 17 bp, Artificial Sequence
  Synthetic Polynucleotide
caatgattgaggcatgg

SEQ ID NO: 6721 - DNA, 20 bp, Artificial Sequence
  Synthetic Polynucleotide
ctgcatgtgggcttccttag

SEQ ID NO: 6722 - DNA, 20 bp, Artificial Sequence
  Synthetic Polynucleotide
aacttaggagaacaaatgtt

SEQ ID NO: 6723 - DNA, 20 bp, Artificial Sequence
  Synthetic Polynucleotide
cactgaaactaaagagaaca

SEQ ID NO: 6724 - DNA, 17 bp, Artificial Sequence
  Synthetic Polynucleotide
gcaagttgtttggactt

SEQ ID NO: 6725 - DNA, 17 bp, Artificial Sequence
  Synthetic Polynucleotide
tgagtaaccttcctcca

SEQ ID NO: 6726 - DNA, 18 bp, Artificial Sequence
  Synthetic Polynucleotide
ggaaccgttttacgactc

SEQ ID NO: 6727 - DNA, 20 bp, Artificial Sequence
  Synthetic Polynucleotide
gctgtaaatgatcgagtttt

SEQ ID NO: 6728 - DNA, 17 bp, Artificial Sequence
  Synthetic Polynucleotide
aacataaaggcagttgc

SEQ ID NO: 6729 - DNA, 18 bp, Artificial Sequence
  Synthetic Polynucleotide
ctcaatatacgcttcagc

SEQ ID NO: 6730 - DNA, 18 bp, Artificial Sequence
  Synthetic Polynucleotide
gtgggtgtattgtgacgc

SEQ ID NO: 6731 - DNA, 17 bp, Artificial Sequence
  Synthetic Polynucleotide
gggaatgttgtgaagta

SEQ ID NO: 6732 - DNA, 20 bp, Artificial Sequence
  Synthetic Polynucleotide
aagttaaattatgctgtggc

SEQ ID NO: 6733 - DNA, 20 bp, Artificial Sequence
  Synthetic Polynucleotide
ttaaacatggtgtcaaagac

SEQ ID NO: 6734 - DNA, 20 bp, Artificial Sequence
  Synthetic Polynucleotide
cgtacattgaaaagagaaac

SEQ ID NO: 6735 - DNA, 17 bp, Artificial Sequence
  Synthetic Polynucleotide
tctgtgtcctcttcttg

SEQ ID NO: 6736 - DNA, 17 bp, Artificial Sequence
  Synthetic Polynucleotide
gccattgttggatcatg

SEQ ID NO: 6737 - DNA, 18 bp, Artificial Sequence
  Synthetic Polynucleotide
cttcgttgggctcttaag

SEQ ID NO: 6738 - DNA, 18 bp, Artificial Sequence
  Synthetic Polynucleotide
ttggtgattcgaggtaga

SEQ ID NO: 6739 - DNA, 20 bp, Artificial Sequence
  Synthetic Polynucleotide
atacaccaaaccattaatcc

SEQ ID NO: 6740 - DNA, 20 bp, Artificial Sequence
  Synthetic Polynucleotide
gatgatttcaacaaccaatt

SEQ ID NO: 6741 - DNA, 17 bp, Artificial Sequence
  Synthetic Polynucleotide
gctgctgctttcatctg

SEQ ID NO: 6742 - DNA, 17 bp, Artificial Sequence
  Synthetic Polynucleotide
atgccacgatatggtct

SEQ ID NO: 6743 - DNA, 17 bp, Artificial Sequence
  Synthetic Polynucleotide
ccattctcaatgcacca

SEQ ID NO: 6744 - DNA, 18 bp, Artificial Sequence
  Synthetic Polynucleotide
gacaaggacattcacagc

SEQ ID NO: 6745 - DNA, 19 bp, Artificial Sequence
  Synthetic Polynucleotide
caactccgccagataattt

SEQ ID NO: 6746 - DNA, 18 bp, Artificial Sequence
  Synthetic Polynucleotide
ccacacacttgcacatca

SEQ ID NO: 6747 - DNA, 19 bp, Artificial Sequence
  Synthetic Polynucleotide
aagtaagattccaacaacc

SEQ ID NO: 6748 - DNA, 18 bp, Artificial Sequence
  Synthetic Polynucleotide
gtggtaataacgatgagc

SEQ ID NO: 6749 - DNA, 17 bp, Artificial Sequence
  Synthetic Polynucleotide
accgtccgtagaatcct

SEQ ID NO: 6750 - DNA, 17 bp, Artificial Sequence
  Synthetic Polynucleotide
gttttacctccgttgct

SEQ ID NO: 6751 - DNA, 17 bp, Artificial Sequence
  Synthetic Polynucleotide
attctttcctgctccaa

SEQ ID NO: 6752 - DNA, 19 bp, Artificial Sequence
  Synthetic Polynucleotide
ttttccacctttccctcaa

SEQ ID NO: 6753 - DNA, 20 bp, Artificial Sequence
  Synthetic Polynucleotide
gaaatccaatgtttccagaa

SEQ ID NO: 6754 - DNA, 17 bp, Artificial Sequence
  Synthetic Polynucleotide
atgccaaaggacttccc

SEQ ID NO: 6755 - DNA, 17 bp, Artificial Sequence
  Synthetic Polynucleotide
tctccgtgttttcttcc

SEQ ID NO: 6756 - DNA, 19 bp, Artificial Sequence
  Synthetic Polynucleotide
gcaatgatagaatcatggg

SEQ ID NO: 6757 - DNA, 17 bp, Artificial Sequence
  Synthetic Polynucleotide
gttgcccactgttattg

SEQ ID NO: 6758 - DNA, 17 bp, Artificial Sequence
  Synthetic Polynucleotide
gcaacactgatttgcca

SEQ ID NO: 6759 - DNA, 20 bp, Artificial Sequence
  Synthetic Polynucleotide
acatcaaccaacatagctaa

SEQ ID NO: 6760 - DNA, 17 bp, Artificial Sequence
  Synthetic Polynucleotide
cacctgggttcatgtta

SEQ ID NO: 6761 - DNA, 19 bp, Artificial Sequence
  Synthetic Polynucleotide
atttctccaacctttcttc

SEQ ID NO: 6762 - DNA, 20 bp, Artificial Sequence
  Synthetic Polynucleotide
gagtctgtatccacattttg

SEQ ID NO: 6763 - DNA, 20 bp, Artificial Sequence
  Synthetic Polynucleotide
gtctaattgattgtcgcaca

SEQ ID NO: 6764 - DNA, 19 bp, Artificial Sequence
  Synthetic Polynucleotide
gaaaagctcccaacacaac

SEQ ID NO: 6765 - DNA, 19 bp, Artificial Sequence
  Synthetic Polynucleotide
ttctttcttgctcaagctt

SEQ ID NO: 6766 - DNA, 17 bp, Artificial Sequence
  Synthetic Polynucleotide
aggtcaactgtctcaga

SEQ ID NO: 6767 - DNA, 18 bp, Artificial Sequence
  Synthetic Polynucleotide
ttatgtcgtcaaactcgt

SEQ ID NO: 6768 - DNA, 19 bp, Artificial Sequence
  Synthetic Polynucleotide
cagatttgttttcgtctgc

SEQ ID NO: 6769 - DNA, 17 bp, Artificial Sequence
  Synthetic Polynucleotide
tcccactcttccatgaa

SEQ ID NO: 6770 - DNA, 17 bp, Artificial Sequence
  Synthetic Polynucleotide
atgggagtttggaatgg

SEQ ID NO: 6771 - DNA, 18 bp, Artificial Sequence
  Synthetic Polynucleotide
ttagtgaagtttgctcct

SEQ ID NO: 6772 - DNA, 18 bp, Artificial Sequence
  Synthetic Polynucleotide
aaagaagcagatgttcgc

SEQ ID NO: 6773 - DNA, 17 bp, Artificial Sequence
  Synthetic Polynucleotide
tcgatgcaccacaccat

SEQ ID NO: 6774 - DNA, 20 bp, Artificial Sequence
  Synthetic Polynucleotide
agcaccatacatagcagaaa

SEQ ID NO: 6775 - DNA, 17 bp, Artificial Sequence
  Synthetic Polynucleotide
aggctgtgaaaacacgc

SEQ ID NO: 6776 - DNA, 19 bp, Artificial Sequence
  Synthetic Polynucleotide
gaagccattttctacacca

SEQ ID NO: 6777 - DNA, 18 bp, Artificial Sequence
  Synthetic Polynucleotide
gtgacaccattttcgatt

SEQ ID NO: 6778 - DNA, 17 bp, Artificial Sequence
  Synthetic Polynucleotide
agctagacaagcggcaa

SEQ ID NO: 6779 - DNA, 20 bp, Artificial Sequence
  Synthetic Polynucleotide
tcacatttcctgtgtacaaa

SEQ ID NO: 6780 - DNA, 17 bp, Artificial Sequence
  Synthetic Polynucleotide
caaccccacttagcatc

SEQ ID NO: 6781 - DNA, 19 bp, Artificial Sequence
  Synthetic Polynucleotide
agctccatttcttgatgtg

SEQ ID NO: 6782 - DNA, 17 bp, Artificial Sequence
  Synthetic Polynucleotide
taccatgcaaagcgatt

SEQ ID NO: 6783 - DNA, 19 bp, Artificial Sequence
  Synthetic Polynucleotide
gaacccttagtacgccatt

SEQ ID NO: 6784 - DNA, 18 bp, Artificial Sequence
  Synthetic Polynucleotide
gttcatccgatttctgga

SEQ ID NO: 6785 - DNA, 19 bp, Artificial Sequence
  Synthetic Polynucleotide
cacgtaagaaacacctcca

SEQ ID NO: 6786 - DNA, 20 bp, Artificial Sequence
  Synthetic Polynucleotide
gaatgcggttattagaaggc

SEQ ID NO: 6787 - DNA, 20 bp, Artificial Sequence
  Synthetic Polynucleotide
aaatttgttttatccgtggt

SEQ ID NO: 6788 - DNA, 19 bp, Artificial Sequence
  Synthetic Polynucleotide
gatttgatcattgctgttg

SEQ ID NO: 6789 - DNA, 18 bp, Artificial Sequence
  Synthetic Polynucleotide
gagattggaaccacttct

SEQ ID NO: 6790 - DNA, 20 bp, Artificial Sequence
  Synthetic Polynucleotide
gccctggtagcgattatatg

SEQ ID NO: 6791 - DNA, 17 bp, Artificial Sequence
  Synthetic Polynucleotide
gattggccctttagaca

SEQ ID NO: 6792 - DNA, 17 bp, Artificial Sequence
  Synthetic Polynucleotide
tttgctgaaagaacacg

SEQ ID NO: 6793 - DNA, 18 bp, Artificial Sequence
  Synthetic Polynucleotide
gttgtgatgggattatgg

SEQ ID NO: 6794 - DNA, 17 bp, Artificial Sequence
  Synthetic Polynucleotide
cgagtttgatgtcccag

SEQ ID NO: 6795 - DNA, 20 bp, Artificial Sequence
  Synthetic Polynucleotide
cattaactgtccacttgcaa

SEQ ID NO: 6796 - DNA, 20 bp, Artificial Sequence
  Synthetic Polynucleotide
gactcttcctagatcgtgcg

SEQ ID NO: 6797 - DNA, 20 bp, Artificial Sequence
  Synthetic Polynucleotide
tcaactgacttttcctgcgt

SEQ ID NO: 6798 - DNA, 19 bp, Artificial Sequence
  Synthetic Polynucleotide
attgattcatttgggtcat

SEQ ID NO: 6799 - DNA, 20 bp, Artificial Sequence
  Synthetic Polynucleotide
ttgcgagatagcacattcca

SEQ ID NO: 6800 - DNA, 18 bp, Artificial Sequence
  Synthetic Polynucleotide
agcgtcaagaattcctcc

SEQ ID NO: 6801 - DNA, 18 bp, Artificial Sequence
  Synthetic Polynucleotide
ctcgtttcacattgcgta

SEQ ID NO: 6802 - DNA, 20 bp, Artificial Sequence
  Synthetic Polynucleotide
aagcaaatagcagactattt

SEQ ID NO: 6803 - DNA, 17 bp, Artificial Sequence
  Synthetic Polynucleotide
gacgttttctatgcagg

SEQ ID NO: 6804 - DNA, 17 bp, Artificial Sequence
  Synthetic Polynucleotide
tctacctctttagcacc

SEQ ID NO: 6805 - DNA, 19 bp, Artificial Sequence
  Synthetic Polynucleotide
gtcttacgaacaccatttg

SEQ ID NO: 6806 - DNA, 19 bp, Artificial Sequence
  Synthetic Polynucleotide
caaggggcatcacatatgg

SEQ ID NO: 6807 - DNA, 19 bp, Artificial Sequence
  Synthetic Polynucleotide
ctctgtaattccgacccgt

SEQ ID NO: 6808 - DNA, 20 bp, Artificial Sequence
  Synthetic Polynucleotide
ggcgatagtgggatagttct

SEQ ID NO: 6809 - DNA, 20 bp, Artificial Sequence
  Synthetic Polynucleotide
ttcagttttcctctcatcac

SEQ ID NO: 6810 - DNA, 19 bp, Artificial Sequence
  Synthetic Polynucleotide
ttggcactttaagcagagt

SEQ ID NO: 6811 - DNA, 20 bp, Artificial Sequence
  Synthetic Polynucleotide
tgtggaacataagcctttat

SEQ ID NO: 6812 - DNA, 18 bp, Artificial Sequence
  Synthetic Polynucleotide
tcttcatgcgagacaact

SEQ ID NO: 6813 - DNA, 20 bp, Artificial Sequence
  Synthetic Polynucleotide
ttccatatcacctcatggtt

SEQ ID NO: 6814 - DNA, 20 bp, Artificial Sequence
  Synthetic Polynucleotide
attactcacagctctacaga

SEQ ID NO: 6815 - DNA, 18 bp, Artificial Sequence
  Synthetic Polynucleotide
ctctcagtttgcttatgg

SEQ ID NO: 6816 - DNA, 20 bp, Artificial Sequence
  Synthetic Polynucleotide
tacacatttccaatgagaca

SEQ ID NO: 6817 - DNA, 19 bp, Artificial Sequence
  Synthetic Polynucleotide
tactcgcacaagaacaacc

SEQ ID NO: 6818 - DNA, 17 bp, Artificial Sequence
  Synthetic Polynucleotide
tgcacgatctcctggat

SEQ ID NO: 6819 - DNA, 20 bp, Artificial Sequence
  Synthetic Polynucleotide
attccactttgtacattcag

SEQ ID NO: 6820 - DNA, 20 bp, Artificial Sequence
  Synthetic Polynucleotide
accataccttgaacttctaa

SEQ ID NO: 6821 - DNA, 19 bp, Artificial Sequence
  Synthetic Polynucleotide
ccgtattggtacactgtat

SEQ ID NO: 6822 - DNA, 20 bp, Artificial Sequence
  Synthetic Polynucleotide
taacagtagttgccactttt

SEQ ID NO: 6823 - DNA, 17 bp, Artificial Sequence
  Synthetic Polynucleotide
gtaatgacggacgaaga

SEQ ID NO: 6824 - DNA, 20 bp, Artificial Sequence
  Synthetic Polynucleotide
tcctgtataacattctccac

SEQ ID NO: 6825 - DNA, 17 bp, Artificial Sequence
  Synthetic Polynucleotide
tattctaagggacacgt

SEQ ID NO: 6826 - DNA, 17 bp, Artificial Sequence
  Synthetic Polynucleotide
tcggaagataaacacgc

SEQ ID NO: 6827 - DNA, 19 bp, Artificial Sequence
  Synthetic Polynucleotide
caaatgcccaagctagtat

SEQ ID NO: 6828 - DNA, 19 bp, Artificial Sequence
  Synthetic Polynucleotide
attgccactctataactcc

SEQ ID NO: 6829 - DNA, 20 bp, Artificial Sequence
  Synthetic Polynucleotide
ctaacgatatcaccattctt

SEQ ID NO: 6830 - DNA, 19 bp, Artificial Sequence
  Synthetic Polynucleotide
aagagcaggataaagagtt

SEQ ID NO: 6831 - DNA, 20 bp, Artificial Sequence
  Synthetic Polynucleotide
aacaacattcaattcatgtg

SEQ ID NO: 6832 - DNA, 18 bp, Artificial Sequence
  Synthetic Polynucleotide
cacaaacacagccttttg

SEQ ID NO: 6833 - DNA, 17 bp, Artificial Sequence
  Synthetic Polynucleotide
tctcactctcgctattc

SEQ ID NO: 6834 - DNA, 18 bp, Artificial Sequence
  Synthetic Polynucleotide
gacacgttcagaatcgcg

SEQ ID NO: 6835 - DNA, 17 bp, Artificial Sequence
  Synthetic Polynucleotide
gtacgatgcgaatgcag

SEQ ID NO: 6836 - DNA, 18 bp, Artificial Sequence
  Synthetic Polynucleotide
cgggctgatccaaaggtt

SEQ ID NO: 6837 - DNA, 17 bp, Artificial Sequence
  Synthetic Polynucleotide
ttatgccgtgccataac

SEQ ID NO: 6838 - DNA, 20 bp, Artificial Sequence
  Synthetic Polynucleotide
ttggtgaagatggacacgat

SEQ ID NO: 6839 - DNA, 17 bp, Artificial Sequence
  Synthetic Polynucleotide
tggctgacgttatcaac

SEQ ID NO: 6840 - DNA, 19 bp, Artificial Sequence
  Synthetic Polynucleotide
tgagtttagtgccttatca

SEQ ID NO: 6841 - DNA, 17 bp, Artificial Sequence
  Synthetic Polynucleotide
tatgattgactgtggct

SEQ ID NO: 6842 - DNA, 20 bp, Artificial Sequence
  Synthetic Polynucleotide
acacattgagtgtaatcact

SEQ ID NO: 6843 - DNA, 19 bp, Artificial Sequence
  Synthetic Polynucleotide
tagtagagtgctaagagaa

SEQ ID NO: 6844 - DNA, 20 bp, Artificial Sequence
  Synthetic Polynucleotide
agaaaatacaacatcagtgg

SEQ ID NO: 6845 - DNA, 20 bp, Artificial Sequence
  Synthetic Polynucleotide
aattgtaagtgtcggaagca

SEQ ID NO: 6846 - DNA, 18 bp, Artificial Sequence
  Synthetic Polynucleotide
aacttcgaattagggagg

SEQ ID NO: 6847 - DNA, 20 bp, Artificial Sequence
  Synthetic Polynucleotide
acagtatagaatacttgcca

SEQ ID NO: 6848 - DNA, 19 bp, Artificial Sequence
  Synthetic Polynucleotide
ataaactaggaccgagaga

SEQ ID NO: 6849 - DNA, 20 bp, Artificial Sequence
  Synthetic Polynucleotide
ggatatgcgttatgtcactt

SEQ ID NO: 6850 - DNA, 20 bp, Artificial Sequence
  Synthetic Polynucleotide
tctccattctgtctacaaat

SEQ ID NO: 6851 - DNA, 20 bp, Artificial Sequence
  Synthetic Polynucleotide
cgctccagtgtaacaatttg

SEQ ID NO: 6852 - DNA, 20 bp, Artificial Sequence
  Synthetic Polynucleotide
ggttatgctgaagagatcag

SEQ ID NO: 6853 - DNA, 20 bp, Artificial Sequence
  Synthetic Polynucleotide
tcctgaatttacgatatctc

SEQ ID NO: 6854 - DNA, 19 bp, Artificial Sequence
  Synthetic Polynucleotide
ctacacccgctttaatccg

SEQ ID NO: 6855 - DNA, 20 bp, Artificial Sequence
  Synthetic Polynucleotide
gaagatgaatctccgctgtc

SEQ ID NO: 6856 - DNA, 18 bp, Artificial Sequence
  Synthetic Polynucleotide
cgaattacatagggtcgg

SEQ ID NO: 6857 - DNA, 20 bp, Artificial Sequence
  Synthetic Polynucleotide
aaagccttaatccttgaatt

SEQ ID NO: 6858 - DNA, 19 bp, Artificial Sequence
  Synthetic Polynucleotide
aacgagatgcaaatatacg

SEQ ID NO: 6859 - DNA, 19 bp, Artificial Sequence
  Synthetic Polynucleotide
ggatagtagatgctctgat

SEQ ID NO: 6860 - DNA, 20 bp, Artificial Sequence
  Synthetic Polynucleotide
cgcgaacaaagactattcaa

SEQ ID NO: 6861 - DNA, 17 bp, Artificial Sequence
  Synthetic Polynucleotide
gttctacctgctgtgcg

SEQ ID NO: 6862 - DNA, 18 bp, Artificial Sequence
  Synthetic Polynucleotide
cgtgcctggaaatgtata

SEQ ID NO: 6863 - DNA, 19 bp, Artificial Sequence
  Synthetic Polynucleotide
caccgcttagaagagatga

SEQ ID NO: 6864 - DNA, 17 bp, Artificial Sequence
  Synthetic Polynucleotide
ctgccagaaatgccttc

SEQ ID NO: 6865 - DNA, 19 bp, Artificial Sequence
  Synthetic Polynucleotide
gcatcagcatctccacctc

SEQ ID NO: 6866 - DNA, 19 bp, Artificial Sequence
  Synthetic Polynucleotide
tccgaggagttaaaacaga

SEQ ID NO: 6867 - DNA, 20 bp, Artificial Sequence
  Synthetic Polynucleotide
aagtttaaagttcagatgga

SEQ ID NO: 6868 - DNA, 17 bp, Artificial Sequence
  Synthetic Polynucleotide
cgactgccatcgagatg

SEQ ID NO: 6869 - DNA, 17 bp, Artificial Sequence
  Synthetic Polynucleotide
gccctaatccgagttct

SEQ ID NO: 6870 - DNA, 19 bp, Artificial Sequence
  Synthetic Polynucleotide
agtcggttaagaacgcacg

SEQ ID NO: 6871 - DNA, 19 bp, Artificial Sequence
  Synthetic Polynucleotide
cgtcgcccaaccattatat

SEQ ID NO: 6872 - DNA, 18 bp, Artificial Sequence
  Synthetic Polynucleotide
gcagtaagaatggttgca

SEQ ID NO: 6873 - DNA, 18 bp, Artificial Sequence
  Synthetic Polynucleotide
taagtgtgtcgaggatgg

SEQ ID NO: 6874 - DNA, 20 bp, Artificial Sequence
  Synthetic Polynucleotide
catcatgctatccaggttag

SEQ ID NO: 6875 - DNA, 18 bp, Artificial Sequence
  Synthetic Polynucleotide
aggtcgggtaataatgcg

SEQ ID NO: 6876 - DNA, 19 bp, Artificial Sequence
  Synthetic Polynucleotide
cgctacatacgttattgtg

SEQ ID NO: 6877 - DNA, 20 bp, Artificial Sequence
  Synthetic Polynucleotide
gaaagttgcctacttcagta

SEQ ID NO: 6878 - DNA, 17 bp, Artificial Sequence
  Synthetic Polynucleotide
ggacaaggcaaactctc

SEQ ID NO: 6879 - DNA, 19 bp, Artificial Sequence
  Synthetic Polynucleotide
tcttcaccaccccttccaa

SEQ ID NO: 6880 - DNA, 20 bp, Artificial Sequence
  Synthetic Polynucleotide
ccaatgattacgattgtcaa

SEQ ID NO: 6881 - DNA, 20 bp, Artificial Sequence
  Synthetic Polynucleotide
cttccctttataagcaatga

SEQ ID NO: 6882 - DNA, 20 bp, Artificial Sequence
  Synthetic Polynucleotide
ggatttctatttggtacgcg

SEQ ID NO: 6883 - DNA, 19 bp, Artificial Sequence
  Synthetic Polynucleotide
ctcctgccctcatattcac

SEQ ID NO: 6884 - DNA, 20 bp, Artificial Sequence
  Synthetic Polynucleotide
ctctttcagaatcagaatga

SEQ ID NO: 6885 - DNA, 20 bp, Artificial Sequence
  Synthetic Polynucleotide
gcagtaattctagccacgaa

SEQ ID NO: 6886 - DNA, 18 bp, Artificial Sequence
  Synthetic Polynucleotide
cgaaacccaacattacat

SEQ ID NO: 6887 - DNA, 19 bp, Artificial Sequence
  Synthetic Polynucleotide
tttcttcagtttatagccg

SEQ ID NO: 6888 - DNA, 20 bp, Artificial Sequence
  Synthetic Polynucleotide
tcaattccagatcctttaag

SEQ ID NO: 6889 - DNA, 18 bp, Artificial Sequence
  Synthetic Polynucleotide
tagacaaaagaccacata

SEQ ID NO: 6890 - DNA, 19 bp, Artificial Sequence
  Synthetic Polynucleotide
tggatacgttattcatggg

SEQ ID NO: 6891 - DNA, 17 bp, Artificial Sequence
  Synthetic Polynucleotide
caccttcgcctcatcat

SEQ ID NO: 6892 - DNA, 18 bp, Artificial Sequence
  Synthetic Polynucleotide
tgcggaatgattttgatc

SEQ ID NO: 6893 - DNA, 17 bp, Artificial Sequence
  Synthetic Polynucleotide
ttaccactcccaatcac

SEQ ID NO: 6894 - DNA, 17 bp, Artificial Sequence
  Synthetic Polynucleotide
cgtagtctcactcttcc

SEQ ID NO: 6895 - DNA, 19 bp, Artificial Sequence
  Synthetic Polynucleotide
atatgattgacctccgtca

SEQ ID NO: 6896 - DNA, 19 bp, Artificial Sequence
  Synthetic Polynucleotide
gttaaaaccccagcaattc

SEQ ID NO: 6897 - DNA, 19 bp, Artificial Sequence
  Synthetic Polynucleotide
actgcatcacgtatcattt

SEQ ID NO: 6898 - DNA, 20 bp, Artificial Sequence
  Synthetic Polynucleotide
gtacaccttgtctacgcata

SEQ ID NO: 6899 - DNA, 19 bp, Artificial Sequence
  Synthetic Polynucleotide
agttcaggaatcggtacgc

SEQ ID NO: 6900 - DNA, 18 bp, Artificial Sequence
  Synthetic Polynucleotide
atgagtccattccttctc

SEQ ID NO: 6901 - DNA, 20 bp, Artificial Sequence
  Synthetic Polynucleotide
atgtaggagagaatccagag

SEQ ID NO: 6902 - DNA, 19 bp, Artificial Sequence
  Synthetic Polynucleotide
gagaccaaatacccattgc

SEQ ID NO: 6903 - DNA, 19 bp, Artificial Sequence
  Synthetic Polynucleotide
ctccagtatcaaacctagc

SEQ ID NO: 6904 - DNA, 18 bp, Artificial Sequence
  Synthetic Polynucleotide
atcatcacacgcaaatgt

SEQ ID NO: 6905 - DNA, 18 bp, Artificial Sequence
  Synthetic Polynucleotide
gtaatctgacgcacaaac

SEQ ID NO: 6906 - DNA, 19 bp, Artificial Sequence
  Synthetic Polynucleotide
ggatcatgttcacagaaag

SEQ ID NO: 6907 - DNA, 19 bp, Artificial Sequence
  Synthetic Polynucleotide
cagtcggaaagaataaagc

SEQ ID NO: 6908 - DNA, 17 bp, Artificial Sequence
  Synthetic Polynucleotide
aaggcaagagcatcaga

SEQ ID NO: 6909 - DNA, 20 bp, Artificial Sequence
  Synthetic Polynucleotide
caaactaacaaaggagttcg

SEQ ID NO: 6910 - DNA, 20 bp, Artificial Sequence
  Synthetic Polynucleotide
caacgagttcccataggaaa

SEQ ID NO: 6911 - DNA, 20 bp, Artificial Sequence
  Synthetic Polynucleotide
cgcattgtcattggagtaag

SEQ ID NO: 6912 - DNA, 18 bp, Artificial Sequence
  Synthetic Polynucleotide
gacattgagaaccatgtc

SEQ ID NO: 6913 - DNA, 20 bp, Artificial Sequence
  Synthetic Polynucleotide
gaccacatcgccatcatgta

SEQ ID NO: 6914 - DNA, 20 bp, Artificial Sequence
  Synthetic Polynucleotide
gatttagcaagaccatttcc

SEQ ID NO: 6915 - DNA, 18 bp, Artificial Sequence
  Synthetic Polynucleotide
taatcacccagatccaca

SEQ ID NO: 6916 - DNA, 20 bp, Artificial Sequence
  Synthetic Polynucleotide
catgagaatccagctagata

SEQ ID NO: 6917 - DNA, 19 bp, Artificial Sequence
  Synthetic Polynucleotide
accatcatccattgattct

SEQ ID NO: 6918 - DNA, 18 bp, Artificial Sequence
  Synthetic Polynucleotide
ggacttccagtttcatcc

SEQ ID NO: 6919 - DNA, 20 bp, Artificial Sequence
  Synthetic Polynucleotide
ttggcacggcattaccaatc

SEQ ID NO: 6920 - DNA, 18 bp, Artificial Sequence
  Synthetic Polynucleotide
ttttacactgtcgccgtc

SEQ ID NO: 6921 - DNA, 19 bp, Artificial Sequence
  Synthetic Polynucleotide
gacaatataaccgcaggca

SEQ ID NO: 6922 - DNA, 17 bp, Artificial Sequence
  Synthetic Polynucleotide
gtcacttcaagacgcaa

SEQ ID NO: 6923 - DNA, 17 bp, Artificial Sequence
  Synthetic Polynucleotide
tatcttgagcacccact

SEQ ID NO: 6924 - DNA, 18 bp, Artificial Sequence
  Synthetic Polynucleotide
atcgtcccatctcgcaaa

SEQ ID NO: 6925 - DNA, 17 bp, Artificial Sequence
  Synthetic Polynucleotide
taattccatctggctga

SEQ ID NO: 6926 - DNA, 17 bp, Artificial Sequence
  Synthetic Polynucleotide
cctaccgaacatggaaa

SEQ ID NO: 6927 - DNA, 17 bp, Artificial Sequence
  Synthetic Polynucleotide
gggtgtgttgccatacg

SEQ ID NO: 6928 - DNA, 19 bp, Artificial Sequence
  Synthetic Polynucleotide
atgctgaaccttgaaccgg

SEQ ID NO: 6929 - DNA, 20 bp, Artificial Sequence
  Synthetic Polynucleotide
ccttgtagttaatggttgaa

SEQ ID NO: 6930 - DNA, 20 bp, Artificial Sequence
  Synthetic Polynucleotide
gttttagaggaaatgcccga

SEQ ID NO: 6931 - DNA, 17 bp, Artificial Sequence
  Synthetic Polynucleotide
agccctagctaatcgag

SEQ ID NO: 6932 - DNA, 17 bp, Artificial Sequence
  Synthetic Polynucleotide
cctttctgcttagccta

SEQ ID NO: 6933 - DNA, 20 bp, Artificial Sequence
  Synthetic Polynucleotide
ttcacagaaactgctgctcg

SEQ ID NO: 6934 - DNA, 18 bp, Artificial Sequence
  Synthetic Polynucleotide
acatggagaaaagaggca

SEQ ID NO: 6935 - DNA, 18 bp, Artificial Sequence
  Synthetic Polynucleotide
agctgcccgaataaaacc

SEQ ID NO: 6936 - DNA, 18 bp, Artificial Sequence
  Synthetic Polynucleotide
acgacgtaccaaagtata

SEQ ID NO: 6937 - DNA, 17 bp, Artificial Sequence
  Synthetic Polynucleotide
ccagctctctcactacc

SEQ ID NO: 6938 - DNA, 20 bp, Artificial Sequence
  Synthetic Polynucleotide
ctgaaggattacgcaaatat

SEQ ID NO: 6939 - DNA, 17 bp, Artificial Sequence
  Synthetic Polynucleotide
atcaacaaaagcactgc

SEQ ID NO: 6940 - DNA, 17 bp, Artificial Sequence
  Synthetic Polynucleotide
tctgccccgagttttaa

SEQ ID NO: 6941 - DNA, 17 bp, Artificial Sequence
  Synthetic Polynucleotide
ccgcttgatcccactgt

SEQ ID NO: 6942 - DNA, 17 bp, Artificial Sequence
  Synthetic Polynucleotide
cgcactagatcaactga

SEQ ID NO: 6943 - DNA, 18 bp, Artificial Sequence
  Synthetic Polynucleotide
attcccaactttccaaac

SEQ ID NO: 6944 - DNA, 18 bp, Artificial Sequence
  Synthetic Polynucleotide
tcatcttcgtcaggaata

SEQ ID NO: 6945 - DNA, 19 bp, Artificial Sequence
  Synthetic Polynucleotide
tggatgagtccaaaactgg

SEQ ID NO: 6946 - DNA, 19 bp, Artificial Sequence
  Synthetic Polynucleotide
tcatcgtgttagaatgctt

SEQ ID NO: 6947 - DNA, 17 bp, Artificial Sequence
  Synthetic Polynucleotide
gacgctccgacactttg

SEQ ID NO: 6948 - DNA, 19 bp, Artificial Sequence
  Synthetic Polynucleotide
aacgataacttcgctcaag

SEQ ID NO: 6949 - DNA, 19 bp, Artificial Sequence
  Synthetic Polynucleotide
ccacttgacatgacattaa

SEQ ID NO: 6950 - DNA, 17 bp, Artificial Sequence
  Synthetic Polynucleotide
agcaaactatccgagta

SEQ ID NO: 6951 - DNA, 20 bp, Artificial Sequence
  Synthetic Polynucleotide
atgcaagtccgtataatagt

SEQ ID NO: 6952 - DNA, 20 bp, Artificial Sequence
  Synthetic Polynucleotide
tcactcactaccgcaaagat

SEQ ID NO: 6953 - DNA, 17 bp, Artificial Sequence
  Synthetic Polynucleotide
gcgagaagacataggtt

SEQ ID NO: 6954 - DNA, 18 bp, Artificial Sequence
  Synthetic Polynucleotide
taacctgtatccgtttcc

SEQ ID NO: 6955 - DNA, 20 bp, Artificial Sequence
  Synthetic Polynucleotide
agctagatcgtgatttattg

SEQ ID NO: 6956 - DNA, 20 bp, Artificial Sequence
  Synthetic Polynucleotide
tcataattgacgcccctaga

SEQ ID NO: 6957 - DNA, 17 bp, Artificial Sequence
  Synthetic Polynucleotide
cgaaaccccgccataaa

SEQ ID NO: 6958 - DNA, 19 bp, Artificial Sequence
  Synthetic Polynucleotide
atacagcaacgtattgaca

SEQ ID NO: 6959 - DNA, 18 bp, Artificial Sequence
  Synthetic Polynucleotide
tattcgctcgactagtag

SEQ ID NO: 6960 - DNA, 20 bp, Artificial Sequence
  Synthetic Polynucleotide
aaacgcatatagttgagtgg

SEQ ID NO: 6961 - DNA, 17 bp, Artificial Sequence
  Synthetic Polynucleotide
ccacttgtttgacggag

SEQ ID NO: 6962 - DNA, 19 bp, Artificial Sequence
  Synthetic Polynucleotide
agagcctctgtataagaac

SEQ ID NO: 6963 - DNA, 19 bp, Artificial Sequence
  Synthetic Polynucleotide
acaacgtaagagagcaaac

SEQ ID NO: 6964 - DNA, 17 bp, Artificial Sequence
  Synthetic Polynucleotide
ttttcctgttgagacgt

SEQ ID NO: 6965 - DNA, 20 bp, Artificial Sequence
  Synthetic Polynucleotide
ttccacttcctttatttcca

SEQ ID NO: 6966 - DNA, 18 bp, Artificial Sequence
  Synthetic Polynucleotide
ggtatggagatgtacaga

SEQ ID NO: 6967 - DNA, 19 bp, Artificial Sequence
  Synthetic Polynucleotide
cttgaacttcccaaatctc

SEQ ID NO: 6968 - DNA, 17 bp, Artificial Sequence
  Synthetic Polynucleotide
tgagatttgcagttcca

SEQ ID NO: 6969 - DNA, 19 bp, Artificial Sequence
  Synthetic Polynucleotide
cgtaccattcgtagaagaa

SEQ ID NO: 6970 - DNA, 19 bp, Artificial Sequence
  Synthetic Polynucleotide
ttcaagtatttctgacgca

SEQ ID NO: 6971 - DNA, 17 bp, Artificial Sequence
  Synthetic Polynucleotide
agtccagtccatcgtgg

SEQ ID NO: 6972 - DNA, 19 bp, Artificial Sequence
  Synthetic Polynucleotide
cttctggacccaattgttc

SEQ ID NO: 6973 - DNA, 20 bp, Artificial Sequence
  Synthetic Polynucleotide
atccttggtatagacgtatg

SEQ ID NO: 6974 - DNA, 18 bp, Artificial Sequence
  Synthetic Polynucleotide
cggcctatatctggaatg

SEQ ID NO: 6975 - DNA, 20 bp, Artificial Sequence
  Synthetic Polynucleotide
cagcagttagcatactactc

SEQ ID NO: 6976 - DNA, 18 bp, Artificial Sequence
  Synthetic Polynucleotide
cttcccgcagcatttcta

SEQ ID NO: 6977 - DNA, 17 bp, Artificial Sequence
  Synthetic Polynucleotide
agccatcaaaacctggc

SEQ ID NO: 6978 - DNA, 18 bp, Artificial Sequence
  Synthetic Polynucleotide
gcttgagaaaacatcgaa

SEQ ID NO: 6979 - DNA, 20 bp, Artificial Sequence
  Synthetic Polynucleotide
agcctaaaatcgctcctttt

SEQ ID NO: 6980 - DNA, 18 bp, Artificial Sequence
  Synthetic Polynucleotide
ccaagccttccaacgctt

SEQ ID NO: 6981 - DNA, 20 bp, Artificial Sequence
  Synthetic Polynucleotide
cccttccttcttagttcgat

SEQ ID NO: 6982 - DNA, 18 bp, Artificial Sequence
  Synthetic Polynucleotide
agatcgtccttcctgtcc

SEQ ID NO: 6983 - DNA, 17 bp, Artificial Sequence
  Synthetic Polynucleotide
tacatcgtagaaacgcc

SEQ ID NO: 6984 - DNA, 18 bp, Artificial Sequence
  Synthetic Polynucleotide
acgacgcaagagatgagc

SEQ ID NO: 6985 - DNA, 20 bp, Artificial Sequence
  Synthetic Polynucleotide
attcgggcatttgaaatacc

SEQ ID NO: 6986 - DNA, 18 bp, Artificial Sequence
  Synthetic Polynucleotide
taaagcagaaaagatccg

SEQ ID NO: 6987 - DNA, 19 bp, Artificial Sequence
  Synthetic Polynucleotide
cttctgtaccgtgatacta

SEQ ID NO: 6988 - DNA, 18 bp, Artificial Sequence
  Synthetic Polynucleotide
caccacatgtttctatgc

SEQ ID NO: 6989 - DNA, 18 bp, Artificial Sequence
  Synthetic Polynucleotide
ggtgcaataactggaggt

SEQ ID NO: 6990 - DNA, 19 bp, Artificial Sequence
  Synthetic Polynucleotide
aagaagctaatggaactta

SEQ ID NO: 6991 - DNA, 18 bp, Artificial Sequence
  Synthetic Polynucleotide
tacttggcactagcgata

SEQ ID NO: 6992 - DNA, 19 bp, Artificial Sequence
  Synthetic Polynucleotide
gtgcagaaaagaaagagaa

SEQ ID NO: 6993 - DNA, 20 bp, Artificial Sequence
  Synthetic Polynucleotide
ctgcgatccgtttatgatga

SEQ ID NO: 6994 - DNA, 19 bp, Artificial Sequence
  Synthetic Polynucleotide
gaggtgtacatttcgttgc

SEQ ID NO: 6995 - DNA, 20 bp, Artificial Sequence
  Synthetic Polynucleotide
gagaatgttgggaatgaaat

SEQ ID NO: 6996 - DNA, 19 bp, Artificial Sequence
  Synthetic Polynucleotide
gcttgaacaggcagttgat

SEQ ID NO: 6997 - DNA, 20 bp, Artificial Sequence
  Synthetic Polynucleotide
atgctgtgtctatcgtttcc

SEQ ID NO: 6998 - DNA, 17 bp, Artificial Sequence
  Synthetic Polynucleotide
aggctgaccaatacaga

SEQ ID NO: 6999 - DNA, 19 bp, Artificial Sequence
  Synthetic Polynucleotide
ggcaagaaggattctacta

SEQ ID NO: 7000 - DNA, 17 bp, Artificial Sequence
  Synthetic Polynucleotide
tggaggatttcttcggg

SEQ ID NO: 7001 - DNA, 19 bp, Artificial Sequence
  Synthetic Polynucleotide
cgactaggaagagcgaata

SEQ ID NO: 7002 - DNA, 18 bp, Artificial Sequence
  Synthetic Polynucleotide
ttggcatttcagtgattc

SEQ ID NO: 7003 - DNA, 20 bp, Artificial Sequence
  Synthetic Polynucleotide
gatgcgaggtaagggttgag

SEQ ID NO: 7004 - DNA, 19 bp, Artificial Sequence
  Synthetic Polynucleotide
cagtcatccgtaaccctgt

SEQ ID NO: 7005 - DNA, 19 bp, Artificial Sequence
  Synthetic Polynucleotide
acgagtaggcaaattaggt

SEQ ID NO: 7006 - DNA, 18 bp, Artificial Sequence
  Synthetic Polynucleotide
gatattctgactcaccga

SEQ ID NO: 7007 - DNA, 19 bp, Artificial Sequence
  Synthetic Polynucleotide
cgggctaggacatttctca

SEQ ID NO: 7008 - DNA, 20 bp, Artificial Sequence
  Synthetic Polynucleotide
tcgtctaaacaagaaggata

SEQ ID NO: 7009 - DNA, 17 bp, Artificial Sequence
  Synthetic Polynucleotide
gtgaatgaagttgtcga

SEQ ID NO: 7010 - DNA, 19 bp, Artificial Sequence
  Synthetic Polynucleotide
gtcccatgatgtttccgtt

SEQ ID NO: 7011 - DNA, 19 bp, Artificial Sequence
  Synthetic Polynucleotide
ttgcgtcattgaacactcc

SEQ ID NO: 7012 - DNA, 17 bp, Artificial Sequence
  Synthetic Polynucleotide
ttctatccgacgtgatc

SEQ ID NO: 7013 - DNA, 17 bp, Artificial Sequence
  Synthetic Polynucleotide
ggctatccaatggttgc

SEQ ID NO: 7014 - DNA, 17 bp, Artificial Sequence
  Synthetic Polynucleotide
agaggttcgaggagaaa

SEQ ID NO: 7015 - DNA, 17 bp, Artificial Sequence
  Synthetic Polynucleotide
tctatatgcgtaccctc

SEQ ID NO: 7016 - DNA, 19 bp, Artificial Sequence
  Synthetic Polynucleotide
aacatcagttggtgaatcg

SEQ ID NO: 7017 - DNA, 20 bp, Artificial Sequence
  Synthetic Polynucleotide
aacgactttcattgctctga

SEQ ID NO: 7018 - DNA, 17 bp, Artificial Sequence
  Synthetic Polynucleotide
ggtgaatgtagggagag

SEQ ID NO: 7019 - DNA, 20 bp, Artificial Sequence
  Synthetic Polynucleotide
actgacattgccccagaact

SEQ ID NO: 7020 - DNA, 19 bp, Artificial Sequence
  Synthetic Polynucleotide
gatgttgaatgtgacacta

SEQ ID NO: 7021 - DNA, 18 bp, Artificial Sequence
  Synthetic Polynucleotide
cgtccaggctctctttag

SEQ ID NO: 7022 - DNA, 20 bp, Artificial Sequence
  Synthetic Polynucleotide
gggagttttgtttgtagaag

SEQ ID NO: 7023 - DNA, 17 bp, Artificial Sequence
  Synthetic Polynucleotide
cgtctagtaccttgctt

SEQ ID NO: 7024 - DNA, 17 bp, Artificial Sequence
  Synthetic Polynucleotide
cgaaaaccgtaaaccca

SEQ ID NO: 7025 - DNA, 18 bp, Artificial Sequence
  Synthetic Polynucleotide
gactcggaacaaatgcgt

SEQ ID NO: 7026 - DNA, 20 bp, Artificial Sequence
  Synthetic Polynucleotide
tttccgaattttaaacagga

SEQ ID NO: 7027 - DNA, 18 bp, Artificial Sequence
  Synthetic Polynucleotide
tccagtattgacctcaag

SEQ ID NO: 7028 - DNA, 17 bp, Artificial Sequence
  Synthetic Polynucleotide
attcatcgttggcattc

SEQ ID NO: 7029 - DNA, 17 bp, Artificial Sequence
  Synthetic Polynucleotide
gatatgtgcctctggta

SEQ ID NO: 7030 - DNA, 17 bp, Artificial Sequence
  Synthetic Polynucleotide
attggctgcatctgaag

SEQ ID NO: 7031 - DNA, 18 bp, Artificial Sequence
  Synthetic Polynucleotide
gccacagaatcatctgat

SEQ ID NO: 7032 - DNA, 18 bp, Artificial Sequence
  Synthetic Polynucleotide
aatcatcaagcatccacc

SEQ ID NO: 7033 - DNA, 20 bp, Artificial Sequence
  Synthetic Polynucleotide
atctgctgttaaccccatcg

SEQ ID NO: 7034 - DNA, 20 bp, Artificial Sequence
  Synthetic Polynucleotide
gctaatttagttacacacga

SEQ ID NO: 7035 - DNA, 18 bp, Artificial Sequence
  Synthetic Polynucleotide
gccgtattgaactgcccc

SEQ ID NO: 7036 - DNA, 18 bp, Artificial Sequence
  Synthetic Polynucleotide
gcgtagaacaatttgcgg

SEQ ID NO: 7037 - DNA, 20 bp, Artificial Sequence
  Synthetic Polynucleotide
gctcagatcgtactctataa

SEQ ID NO: 7038 - DNA, 18 bp, Artificial Sequence
  Synthetic Polynucleotide
tcgccgaaaagatcagag

SEQ ID NO: 7039 - DNA, 20 bp, Artificial Sequence
  Synthetic Polynucleotide
gtattttcatccatgaccgt

SEQ ID NO: 7040 - DNA, 19 bp, Artificial Sequence
  Synthetic Polynucleotide
gattacccattaggtgaac

SEQ ID NO: 7041 - DNA, 19 bp, Artificial Sequence
  Synthetic Polynucleotide
aggaacccatgtaatcaat

SEQ ID NO: 7042 - DNA, 20 bp, Artificial Sequence
  Synthetic Polynucleotide
atgtcccatttatatatgcc

SEQ ID NO: 7043 - DNA, 18 bp, Artificial Sequence
  Synthetic Polynucleotide
cgaagaaacatcacgaac

SEQ ID NO: 7044 - DNA, 18 bp, Artificial Sequence
  Synthetic Polynucleotide
aacgaaatacacatccct

SEQ ID NO: 7045 - DNA, 19 bp, Artificial Sequence
  Synthetic Polynucleotide
tgggcgagtcattatctcc

SEQ ID NO: 7046 - DNA, 19 bp, Artificial Sequence
  Synthetic Polynucleotide
tctttagaagaaagtggta

SEQ ID NO: 7047 - DNA, 18 bp, Artificial Sequence
  Synthetic Polynucleotide
gtgcttcaagacagccgt

SEQ ID NO: 7048 - DNA, 17 bp, Artificial Sequence
  Synthetic Polynucleotide
ctcagacctagatgcta

SEQ ID NO: 7049 - DNA, 17 bp, Artificial Sequence
  Synthetic Polynucleotide
cccaacgctacaaatct

SEQ ID NO: 7050 - DNA, 19 bp, Artificial Sequence
  Synthetic Polynucleotide
tatgcctttccctttcgtg

SEQ ID NO: 7051 - DNA, 18 bp, Artificial Sequence
  Synthetic Polynucleotide
cagagcttcgtattcaga

SEQ ID NO: 7052 - DNA, 19 bp, Artificial Sequence
  Synthetic Polynucleotide
cagcttgtgaccatgatct

SEQ ID NO: 7053 - DNA, 17 bp, Artificial Sequence
  Synthetic Polynucleotide
ccgctttacgtcctgcc

SEQ ID NO: 7054 - DNA, 18 bp, Artificial Sequence
  Synthetic Polynucleotide
gaccaaacttcccagttg

SEQ ID NO: 7055 - DNA, 19 bp, Artificial Sequence
  Synthetic Polynucleotide
ccctctccagaactaaatt

SEQ ID NO: 7056 - DNA, 20 bp, Artificial Sequence
  Synthetic Polynucleotide
ttccaggttatgaagtagag

SEQ ID NO: 7057 - DNA, 18 bp, Artificial Sequence
  Synthetic Polynucleotide
catcaatcgagttcagca

SEQ ID NO: 7058 - DNA, 17 bp, Artificial Sequence
  Synthetic Polynucleotide
aacaagtaccgttcgat

SEQ ID NO: 7059 - DNA, 17 bp, Artificial Sequence
  Synthetic Polynucleotide
tcaccaaacagagagtt

SEQ ID NO: 7060 - DNA, 20 bp, Artificial Sequence
  Synthetic Polynucleotide
ccaaaagtgagtattcctga

SEQ ID NO: 7061 - DNA, 19 bp, Artificial Sequence
  Synthetic Polynucleotide
tgcagttcaagaaacgatc

SEQ ID NO: 7062 - DNA, 18 bp, Artificial Sequence
  Synthetic Polynucleotide
aatcccatattgcaccga

SEQ ID NO: 7063 - DNA, 19 bp, Artificial Sequence
  Synthetic Polynucleotide
gttagtgaaatcccaatcc

SEQ ID NO: 7064 - DNA, 19 bp, Artificial Sequence
  Synthetic Polynucleotide
gcaataccatcctgtgttt

SEQ ID NO: 7065 - DNA, 17 bp, Artificial Sequence
  Synthetic Polynucleotide
tggccgataggagactg

SEQ ID NO: 7066 - DNA, 20 bp, Artificial Sequence
  Synthetic Polynucleotide
ttaccagcaagagcttcagg

SEQ ID NO: 7067 - DNA, 17 bp, Artificial Sequence
  Synthetic Polynucleotide
caccaatcctcgacaat

SEQ ID NO: 7068 - DNA, 18 bp, Artificial Sequence
  Synthetic Polynucleotide
gcccatattcatcaggct

SEQ ID NO: 7069 - DNA, 19 bp, Artificial Sequence
  Synthetic Polynucleotide
cattcgttcaatccaaaga

SEQ ID NO: 7070 - DNA, 19 bp, Artificial Sequence
  Synthetic Polynucleotide
cgcttatgcaacaatcagg

SEQ ID NO: 7071 - DNA, 17 bp, Artificial Sequence
  Synthetic Polynucleotide
agtcctaaacctccaca

SEQ ID NO: 7072 - DNA, 19 bp, Artificial Sequence
  Synthetic Polynucleotide
catctatcagatccttccg

SEQ ID NO: 7073 - DNA, 17 bp, Artificial Sequence
  Synthetic Polynucleotide
aaaccaacaccagaacc

SEQ ID NO: 7074 - DNA, 18 bp, Artificial Sequence
  Synthetic Polynucleotide
aattacgcaacaatcctc

SEQ ID NO: 7075 - DNA, 18 bp, Artificial Sequence
  Synthetic Polynucleotide
cactgccatcacgggttt

SEQ ID NO: 7076 - DNA, 17 bp, Artificial Sequence
  Synthetic Polynucleotide
cgattgctcgtcgtggg

SEQ ID NO: 7077 - DNA, 17 bp, Artificial Sequence
  Synthetic Polynucleotide
tccattctccgcctcgt

SEQ ID NO: 7078 - DNA, 19 bp, Artificial Sequence
  Synthetic Polynucleotide
tggaagtctaggtcaaaac

SEQ ID NO: 7079 - DNA, 17 bp, Artificial Sequence
  Synthetic Polynucleotide
acctctcgaatagccta

SEQ ID NO: 7080 - DNA, 19 bp, Artificial Sequence
  Synthetic Polynucleotide
tgtaccacagttcttaaca

SEQ ID NO: 7081 - DNA, 18 bp, Artificial Sequence
  Synthetic Polynucleotide
gcaatattttcctgccac

SEQ ID NO: 7082 - DNA, 19 bp, Artificial Sequence
  Synthetic Polynucleotide
tgttgctgttgttcaagtt

SEQ ID NO: 7083 - DNA, 19 bp, Artificial Sequence
  Synthetic Polynucleotide
tgattaagtatcccaagcg

SEQ ID NO: 7084 - DNA, 17 bp, Artificial Sequence
  Synthetic Polynucleotide
catgagtctagctacga

SEQ ID NO: 7085 - DNA, 20 bp, Artificial Sequence
  Synthetic Polynucleotide
cattacagaaccaaagtagg

SEQ ID NO: 7086 - DNA, 17 bp, Artificial Sequence
  Synthetic Polynucleotide
aggagttagtgccgctt

SEQ ID NO: 7087 - DNA, 20 bp, Artificial Sequence
  Synthetic Polynucleotide
gaaatccagttggtctaact

SEQ ID NO: 7088 - DNA, 18 bp, Artificial Sequence
  Synthetic Polynucleotide
gtgaagtgaatcatgtgc

SEQ ID NO: 7089 - DNA, 20 bp, Artificial Sequence
  Synthetic Polynucleotide
atgcctttaattacgccacc

SEQ ID NO: 7090 - DNA, 17 bp, Artificial Sequence
  Synthetic Polynucleotide
gtcattgcatggttgac

SEQ ID NO: 7091 - DNA, 20 bp, Artificial Sequence
  Synthetic Polynucleotide
ctactgtcacacaaagccaa

SEQ ID NO: 7092 - DNA, 19 bp, Artificial Sequence
  Synthetic Polynucleotide
atgataggattgtgcgata

SEQ ID NO: 7093 - DNA, 18 bp, Artificial Sequence
  Synthetic Polynucleotide
cgatatcatagtgcatcg

SEQ ID NO: 7094 - DNA, 18 bp, Artificial Sequence
  Synthetic Polynucleotide
gaagcaccgactaaagaa

SEQ ID NO: 7095 - DNA, 19 bp, Artificial Sequence
  Synthetic Polynucleotide
cagcatctgtctcaaataa

SEQ ID NO: 7096 - DNA, 20 bp, Artificial Sequence
  Synthetic Polynucleotide
agatccagagataatcgggg

SEQ ID NO: 7097 - DNA, 19 bp, Artificial Sequence
  Synthetic Polynucleotide
tcatttccctgctcaccaa

SEQ ID NO: 7098 - DNA, 17 bp, Artificial Sequence
  Synthetic Polynucleotide
ttcttgccgtttaccaa

SEQ ID NO: 7099 - DNA, 18 bp, Artificial Sequence
  Synthetic Polynucleotide
ctggtcaaagctgcccta

SEQ ID NO: 7100 - DNA, 17 bp, Artificial Sequence
  Synthetic Polynucleotide
ggacatcgatcaaacgt

SEQ ID NO: 7101 - DNA, 17 bp, Artificial Sequence
  Synthetic Polynucleotide
cattccgttgttcttgc

SEQ ID NO: 7102 - DNA, 20 bp, Artificial Sequence
  Synthetic Polynucleotide
cgagtcaaacgtattagaaa

SEQ ID NO: 7103 - DNA, 19 bp, Artificial Sequence
  Synthetic Polynucleotide
tgagtccgtctgtcaatta

SEQ ID NO: 7104 - DNA, 18 bp, Artificial Sequence
  Synthetic Polynucleotide
ggagatgtaatagacgct

SEQ ID NO: 7105 - DNA, 19 bp, Artificial Sequence
  Synthetic Polynucleotide
cattcaacttgaccctcac

SEQ ID NO: 7106 - DNA, 19 bp, Artificial Sequence
  Synthetic Polynucleotide
tcgatcatcaaacagagat

SEQ ID NO: 7107 - DNA, 20 bp, Artificial Sequence
  Synthetic Polynucleotide
gcttttatggtagcaaaatc

SEQ ID NO: 7108 - DNA, 20 bp, Artificial Sequence
  Synthetic Polynucleotide
tgatggtttcaactactaac

SEQ ID NO: 7109 - DNA, 20 bp, Artificial Sequence
  Synthetic Polynucleotide
gcgcatcgcttctcgtatac

SEQ ID NO: 7110 - DNA, 17 bp, Artificial Sequence
  Synthetic Polynucleotide
agtcgctgaaattcgga

SEQ ID NO: 7111 - DNA, 20 bp, Artificial Sequence
  Synthetic Polynucleotide
caatctccgcaacacatcca

SEQ ID NO: 7112 - DNA, 17 bp, Artificial Sequence
  Synthetic Polynucleotide
cgttcttccagctcagt

SEQ ID NO: 7113 - DNA, 20 bp, Artificial Sequence
  Synthetic Polynucleotide
cctgcaatcaatgccgctaa

SEQ ID NO: 7114 - DNA, 17 bp, Artificial Sequence
  Synthetic Polynucleotide
aaaacctccagatgtcg

SEQ ID NO: 7115 - DNA, 18 bp, Artificial Sequence
  Synthetic Polynucleotide
ccatcatggttacccatt

SEQ ID NO: 7116 - DNA, 18 bp, Artificial Sequence
  Synthetic Polynucleotide
ttcaccaggaaaacttgc

SEQ ID NO: 7117 - DNA, 17 bp, Artificial Sequence
  Synthetic Polynucleotide
gcgtataagaggtcgtg

SEQ ID NO: 7118 - DNA, 20 bp, Artificial Sequence
  Synthetic Polynucleotide
gagacttcagtcgcaaacta

SEQ ID NO: 7119 - DNA, 19 bp, Artificial Sequence
  Synthetic Polynucleotide
tgaatacataggcaccctc

SEQ ID NO: 7120 - DNA, 20 bp, Artificial Sequence
  Synthetic Polynucleotide
ccgccattctatcataagaa

SEQ ID NO: 7121 - DNA, 19 bp, Artificial Sequence
  Synthetic Polynucleotide
accacgtctcatgtccacc

SEQ ID NO: 7122 - DNA, 20 bp, Artificial Sequence
  Synthetic Polynucleotide
cacacccagccccatactat

SEQ ID NO: 7123 - DNA, 17 bp, Artificial Sequence
  Synthetic Polynucleotide
gagcattccaacgcaaa

SEQ ID NO: 7124 - DNA, 17 bp, Artificial Sequence
  Synthetic Polynucleotide
cgcaataatgttctgca

SEQ ID NO: 7125 - DNA, 19 bp, Artificial Sequence
  Synthetic Polynucleotide
aatgtcccacgcaaactcc

SEQ ID NO: 7126 - DNA, 18 bp, Artificial Sequence
  Synthetic Polynucleotide
ctgatccgccaactcata

SEQ ID NO: 7127 - DNA, 20 bp, Artificial Sequence
  Synthetic Polynucleotide
ggaacagtttcatctttctc

SEQ ID NO: 7128 - DNA, 18 bp, Artificial Sequence
  Synthetic Polynucleotide
ggccaaacagaatcaaga

SEQ ID NO: 7129 - DNA, 19 bp, Artificial Sequence
  Synthetic Polynucleotide
cgccaagagtatcatgtaa

SEQ ID NO: 7130 - DNA, 17 bp, Artificial Sequence
  Synthetic Polynucleotide
aatcagtcgtccaacat

SEQ ID NO: 7131 - DNA, 20 bp, Artificial Sequence
  Synthetic Polynucleotide
ttttagctcactcagacata

SEQ ID NO: 7132 - DNA, 20 bp, Artificial Sequence
  Synthetic Polynucleotide
agggatctgtctaataacaa

SEQ ID NO: 7133 - DNA, 18 bp, Artificial Sequence
  Synthetic Polynucleotide
accttttcaccaaaccgt

SEQ ID NO: 7134 - DNA, 19 bp, Artificial Sequence
  Synthetic Polynucleotide
attttcacgtagttcaggt

SEQ ID NO: 7135 - DNA, 17 bp, Artificial Sequence
  Synthetic Polynucleotide
ccaagccttttcacacc

SEQ ID NO: 7136 - DNA, 17 bp, Artificial Sequence
  Synthetic Polynucleotide
actggaacaaggtgtct

SEQ ID NO: 7137 - DNA, 20 bp, Artificial Sequence
  Synthetic Polynucleotide
attcactttctttgccttct

SEQ ID NO: 7138 - DNA, 20 bp, Artificial Sequence
  Synthetic Polynucleotide
aaaattgaacgtggtgaagt

SEQ ID NO: 7139 - DNA, 20 bp, Artificial Sequence
  Synthetic Polynucleotide
cgtctgaagagtaatcaacc

SEQ ID NO: 7140 - DNA, 18 bp, Artificial Sequence
  Synthetic Polynucleotide
agcttaatggatggacga

SEQ ID NO: 7141 - DNA, 18 bp, Artificial Sequence
  Synthetic Polynucleotide
atcaaaacggtgaccaag

SEQ ID NO: 7142 - DNA, 17 bp, Artificial Sequence
  Synthetic Polynucleotide
tcaactgctgctatgaa

SEQ ID NO: 7143 - DNA, 17 bp, Artificial Sequence
  Synthetic Polynucleotide
cggtgttctcgcctaac

SEQ ID NO: 7144 - DNA, 20 bp, Artificial Sequence
  Synthetic Polynucleotide
ccagtgggttctcattgacg

SEQ ID NO: 7145 - DNA, 19 bp, Artificial Sequence
  Synthetic Polynucleotide
cacttccctttcctgaata

SEQ ID NO: 7146 - DNA, 19 bp, Artificial Sequence
  Synthetic Polynucleotide
agctaatgaccgcaaataa

SEQ ID NO: 7147 - DNA, 19 bp, Artificial Sequence
  Synthetic Polynucleotide
cttgttggtacattcccca

SEQ ID NO: 7148 - DNA, 19 bp, Artificial Sequence
  Synthetic Polynucleotide
atgcatcatcaactgtttc

SEQ ID NO: 7149 - DNA, 19 bp, Artificial Sequence
  Synthetic Polynucleotide
caagcatcactaattggat

SEQ ID NO: 7150 - DNA, 17 bp, Artificial Sequence
  Synthetic Polynucleotide
cgcatgtcggagtgagg

SEQ ID NO: 7151 - DNA, 18 bp, Artificial Sequence
  Synthetic Polynucleotide
ctagcctgatcatcatga

SEQ ID NO: 7152 - DNA, 18 bp, Artificial Sequence
  Synthetic Polynucleotide
cgtagcgaagatggacat

SEQ ID NO: 7153 - DNA, 20 bp, Artificial Sequence
  Synthetic Polynucleotide
ttctgatcattcacttgtac

SEQ ID NO: 7154 - DNA, 18 bp, Artificial Sequence
  Synthetic Polynucleotide
ttctcagtgtaagtggtg

SEQ ID NO: 7155 - DNA, 18 bp, Artificial Sequence
  Synthetic Polynucleotide
agtaagctggaggtacga

SEQ ID NO: 7156 - DNA, 18 bp, Artificial Sequence
  Synthetic Polynucleotide
tactcgggtttgaactca

SEQ ID NO: 7157 - DNA, 18 bp, Artificial Sequence
  Synthetic Polynucleotide
agattctcatttcgggta

SEQ ID NO: 7158 - DNA, 19 bp, Artificial Sequence
  Synthetic Polynucleotide
gagaaattctttctgctga

SEQ ID NO: 7159 - DNA, 20 bp, Artificial Sequence
  Synthetic Polynucleotide
cgtctataccttctaactcc

SEQ ID NO: 7160 - DNA, 20 bp, Artificial Sequence
  Synthetic Polynucleotide
cggcattgatttatcccatt

SEQ ID NO: 7161 - DNA, 18 bp, Artificial Sequence
  Synthetic Polynucleotide
cgaggtgataagtcccct

SEQ ID NO: 7162 - DNA, 17 bp, Artificial Sequence
  Synthetic Polynucleotide
tcggatgtgtttcgtgg

SEQ ID NO: 7163 - DNA, 17 bp, Artificial Sequence
  Synthetic Polynucleotide
cctgactgtctgattgg

SEQ ID NO: 7164 - DNA, 18 bp, Artificial Sequence
  Synthetic Polynucleotide
tgtgacctatgtaaagcc

SEQ ID NO: 7165 - DNA, 18 bp, Artificial Sequence
  Synthetic Polynucleotide
gcaacatggatctgctta

SEQ ID NO: 7166 - DNA, 17 bp, Artificial Sequence
  Synthetic Polynucleotide
cggaagaacccgaaaat

SEQ ID NO: 7167 - DNA, 19 bp, Artificial Sequence
  Synthetic Polynucleotide
atttaggattggagctgac

SEQ ID NO: 7168 - DNA, 20 bp, Artificial Sequence
  Synthetic Polynucleotide
cagttccagccatcaccaac

SEQ ID NO: 7169 - DNA, 19 bp, Artificial Sequence
  Synthetic Polynucleotide
acttcacctttgtcaactt

SEQ ID NO: 7170 - DNA, 18 bp, Artificial Sequence
  Synthetic Polynucleotide
atgatagaaacacgacca

SEQ ID NO: 7171 - DNA, 19 bp, Artificial Sequence
  Synthetic Polynucleotide
ctagacgacgaacacccat

SEQ ID NO: 7172 - DNA, 17 bp, Artificial Sequence
  Synthetic Polynucleotide
ggcgatgaattccctat

SEQ ID NO: 7173 - DNA, 18 bp, Artificial Sequence
  Synthetic Polynucleotide
tgcctgaacgaacggtac

SEQ ID NO: 7174 - DNA, 19 bp, Artificial Sequence
  Synthetic Polynucleotide
ataaccctcatccagtcgg

SEQ ID NO: 7175 - DNA, 20 bp, Artificial Sequence
  Synthetic Polynucleotide
acatggactagcaagcatat

SEQ ID NO: 7176 - DNA, 19 bp, Artificial Sequence
  Synthetic Polynucleotide
aacccctccatcaagtaga

SEQ ID NO: 7177 - DNA, 19 bp, Artificial Sequence
  Synthetic Polynucleotide
tacagtatgcacttcgaat

SEQ ID NO: 7178 - DNA, 19 bp, Artificial Sequence
  Synthetic Polynucleotide
gactttccaacaagggcga

SEQ ID NO: 7179 - DNA, 20 bp, Artificial Sequence
  Synthetic Polynucleotide
aagtattggcgatagattca

SEQ ID NO: 7180 - DNA, 18 bp, Artificial Sequence
  Synthetic Polynucleotide
tggcacattttcaagata

SEQ ID NO: 7181 - DNA, 17 bp, Artificial Sequence
  Synthetic Polynucleotide
agtactcatgacccgac

SEQ ID NO: 7182 - DNA, 20 bp, Artificial Sequence
  Synthetic Polynucleotide
cagagacattcataacagac

SEQ ID NO: 7183 - DNA, 20 bp, Artificial Sequence
  Synthetic Polynucleotide
acactcgtatacaacaccat

SEQ ID NO: 7184 - DNA, 17 bp, Artificial Sequence
  Synthetic Polynucleotide
acccctccacaatagaa

SEQ ID NO: 7185 - DNA, 18 bp, Artificial Sequence
  Synthetic Polynucleotide
ttccatccaccacttaga

SEQ ID NO: 7186 - DNA, 17 bp, Artificial Sequence
  Synthetic Polynucleotide
ctgagattcagaagcgg

SEQ ID NO: 7187 - DNA, 19 bp, Artificial Sequence
  Synthetic Polynucleotide
acatcaagttcaaaccacc

SEQ ID NO: 7188 - DNA, 17 bp, Artificial Sequence
  Synthetic Polynucleotide
ttacctgcggagttaag

SEQ ID NO: 7189 - DNA, 20 bp, Artificial Sequence
  Synthetic Polynucleotide
gggcaagttcattaaacaac

SEQ ID NO: 7190 - DNA, 19 bp, Artificial Sequence
  Synthetic Polynucleotide
cccctaacacattcaatag

SEQ ID NO: 7191 - DNA, 17 bp, Artificial Sequence
  Synthetic Polynucleotide
tcaccagataaatgcgt

SEQ ID NO: 7192 - DNA, 19 bp, Artificial Sequence
  Synthetic Polynucleotide
gccacagtatgatacattg

SEQ ID NO: 7193 - DNA, 20 bp, Artificial Sequence
  Synthetic Polynucleotide
taaagttattgattagcgtg

SEQ ID NO: 7194 - DNA, 18 bp, Artificial Sequence
  Synthetic Polynucleotide
caaagaaacgattcacgg

SEQ ID NO: 7195 - DNA, 19 bp, Artificial Sequence
  Synthetic Polynucleotide
tatgcaagtcgaaaataca

SEQ ID NO: 7196 - DNA, 18 bp, Artificial Sequence
  Synthetic Polynucleotide
ctttgacgagaaatcacg

SEQ ID NO: 7197 - DNA, 19 bp, Artificial Sequence
  Synthetic Polynucleotide
cgtcacaccaggttggtca

SEQ ID NO: 7198 - DNA, 17 bp, Artificial Sequence
  Synthetic Polynucleotide
tctaggtgttgttggat

SEQ ID NO: 7199 - DNA, 20 bp, Artificial Sequence
  Synthetic Polynucleotide
ctgaactagtcgcactaatg

SEQ ID NO: 7200 - DNA, 20 bp, Artificial Sequence
  Synthetic Polynucleotide
tctttggctgtaccttgttt

SEQ ID NO: 7201 - DNA, 18 bp, Artificial Sequence
  Synthetic Polynucleotide
tatcatcgctctatgctc

SEQ ID NO: 7202 - DNA, 20 bp, Artificial Sequence
  Synthetic Polynucleotide
catacccacaaaagatcata

SEQ ID NO: 7203 - DNA, 19 bp, Artificial Sequence
  Synthetic Polynucleotide
taaaactcatcctcaccgc

SEQ ID NO: 7204 - DNA, 17 bp, Artificial Sequence
  Synthetic Polynucleotide
agcggagaaggctgcat

SEQ ID NO: 7205 - DNA, 20 bp, Artificial Sequence
  Synthetic Polynucleotide
ttgctctttcattagaatcc

SEQ ID NO: 7206 - DNA, 20 bp, Artificial Sequence
  Synthetic Polynucleotide
atagaatggggtcggtttat

SEQ ID NO: 7207 - DNA, 19 bp, Artificial Sequence
  Synthetic Polynucleotide
gcctgatgaattgtctgtg

SEQ ID NO: 7208 - DNA, 17 bp, Artificial Sequence
  Synthetic Polynucleotide
tgcaaagatggggaacg

SEQ ID NO: 7209 - DNA, 19 bp, Artificial Sequence
  Synthetic Polynucleotide
tgagagtctttcctgatgc

SEQ ID NO: 7210 - DNA, 20 bp, Artificial Sequence
  Synthetic Polynucleotide
tatcactacattcgcaactc

SEQ ID NO: 7211 - DNA, 17 bp, Artificial Sequence
  Synthetic Polynucleotide
tcacgcatgtctatctt

SEQ ID NO: 7212 - DNA, 17 bp, Artificial Sequence
  Synthetic Polynucleotide
actatggcttcctcact

SEQ ID NO: 7213 - DNA, 19 bp, Artificial Sequence
  Synthetic Polynucleotide
tattcagtggacacacttt

SEQ ID NO: 7214 - DNA, 19 bp, Artificial Sequence
  Synthetic Polynucleotide
aggatcaatggacactgta

SEQ ID NO: 7215 - DNA, 20 bp, Artificial Sequence
  Synthetic Polynucleotide
cctcgcaggtaatcatgtct

SEQ ID NO: 7216 - DNA, 18 bp, Artificial Sequence
  Synthetic Polynucleotide
tccctatggataatcaga

SEQ ID NO: 7217 - DNA, 20 bp, Artificial Sequence
  Synthetic Polynucleotide
gacttatcacatatccgatg

SEQ ID NO: 7218 - DNA, 20 bp, Artificial Sequence
  Synthetic Polynucleotide
cgaagaaaagtatcgttcta

SEQ ID NO: 7219 - DNA, 19 bp, Artificial Sequence
  Synthetic Polynucleotide
catttcctccacggctacc

SEQ ID NO: 7220 - DNA, 19 bp, Artificial Sequence
  Synthetic Polynucleotide
tcacgaactatatggatcc

SEQ ID NO: 7221 - DNA, 20 bp, Artificial Sequence
  Synthetic Polynucleotide
tacattcagaagtttagtca

SEQ ID NO: 7222 - DNA, 20 bp, Artificial Sequence
  Synthetic Polynucleotide
tggagctaactttaatcgat

SEQ ID NO: 7223 - DNA, 19 bp, Artificial Sequence
  Synthetic Polynucleotide
gtttccgatatggacacag

SEQ ID NO: 7224 - DNA, 18 bp, Artificial Sequence
  Synthetic Polynucleotide
aagtcgcacaagataccc

SEQ ID NO: 7225 - DNA, 20 bp, Artificial Sequence
  Synthetic Polynucleotide
tcgtaggttggagtttgtga

SEQ ID NO: 7226 - DNA, 18 bp, Artificial Sequence
  Synthetic Polynucleotide
gatgcgaggcaagagtta

SEQ ID NO: 7227 - DNA, 18 bp, Artificial Sequence
  Synthetic Polynucleotide
actgctgagttcggtctg

SEQ ID NO: 7228 - DNA, 19 bp, Artificial Sequence
  Synthetic Polynucleotide
atgaagatatgtggagtgg

SEQ ID NO: 7229 - DNA, 19 bp, Artificial Sequence
  Synthetic Polynucleotide
gtaaccgctttgacgtaac

SEQ ID NO: 7230 - DNA, 20 bp, Artificial Sequence
  Synthetic Polynucleotide
cgaatacataccagatagtg

SEQ ID NO: 7231 - DNA, 20 bp, Artificial Sequence
  Synthetic Polynucleotide
tctgagaggtaggttccggt

SEQ ID NO: 7232 - DNA, 19 bp, Artificial Sequence
  Synthetic Polynucleotide
gcagatgacgttcgtattg

SEQ ID NO: 7233 - DNA, 19 bp, Artificial Sequence
  Synthetic Polynucleotide
ctgcatgttcccaatcatg

SEQ ID NO: 7234 - DNA, 20 bp, Artificial Sequence
  Synthetic Polynucleotide
tgaaatggtagatgaaacaa

SEQ ID NO: 7235 - DNA, 17 bp, Artificial Sequence
  Synthetic Polynucleotide
tgtgacgctgagtcctt

SEQ ID NO: 7236 - DNA, 19 bp, Artificial Sequence
  Synthetic Polynucleotide
caagttgagtcattggata

SEQ ID NO: 7237 - DNA, 18 bp, Artificial Sequence
  Synthetic Polynucleotide
tacccgctgctaaattat

SEQ ID NO: 7238 - DNA, 20 bp, Artificial Sequence
  Synthetic Polynucleotide
tataggtgtaaagaagaggg

SEQ ID NO: 7239 - DNA, 19 bp, Artificial Sequence
  Synthetic Polynucleotide
tcttcctttccccaagaat

SEQ ID NO: 7240 - DNA, 19 bp, Artificial Sequence
  Synthetic Polynucleotide
aaagatgaggatggacaag

SEQ ID NO: 7241 - DNA, 19 bp, Artificial Sequence
  Synthetic Polynucleotide
ttgggcattctgaaacgac

SEQ ID NO: 7242 - DNA, 20 bp, Artificial Sequence
  Synthetic Polynucleotide
gaaaagtttaaaggtagggt

SEQ ID NO: 7243 - DNA, 19 bp, Artificial Sequence
  Synthetic Polynucleotide
cacattgaaacgacttaga

SEQ ID NO: 7244 - DNA, 20 bp, Artificial Sequence
  Synthetic Polynucleotide
tatgtcggatgatgttaata

SEQ ID NO: 7245 - DNA, 18 bp, Artificial Sequence
  Synthetic Polynucleotide
gagtttgagagaagcaag

SEQ ID NO: 7246 - DNA, 18 bp, Artificial Sequence
  Synthetic Polynucleotide
ggtgagattaaacggatg

SEQ ID NO: 7247 - DNA, 20 bp, Artificial Sequence
  Synthetic Polynucleotide
ttgtggagattgatgatcca

SEQ ID NO: 7248 - DNA, 18 bp, Artificial Sequence
  Synthetic Polynucleotide
cttggtggctattctaga

SEQ ID NO: 7249 - DNA, 18 bp, Artificial Sequence
  Synthetic Polynucleotide
cgtctttaggtggatagc

SEQ ID NO: 7250 - DNA, 17 bp, Artificial Sequence
  Synthetic Polynucleotide
tgggcttgtgctgaatt

SEQ ID NO: 7251 - DNA, 20 bp, Artificial Sequence
  Synthetic Polynucleotide
ttcaacagtaggaatgtagt

SEQ ID NO: 7252 - DNA, 20 bp, Artificial Sequence
  Synthetic Polynucleotide
ttgtcaggtaagtgtctaat

SEQ ID NO: 7253 - DNA, 19 bp, Artificial Sequence
  Synthetic Polynucleotide
tattctttgtgtgtggaac

SEQ ID NO: 7254 - DNA, 19 bp, Artificial Sequence
  Synthetic Polynucleotide
cggtcttatcgaaagttca

SEQ ID NO: 7255 - DNA, 19 bp, Artificial Sequence
  Synthetic Polynucleotide
gttatcctcatcgtttgct

SEQ ID NO: 7256 - DNA, 17 bp, Artificial Sequence
  Synthetic Polynucleotide
ccatctcacactcactg

SEQ ID NO: 7257 - DNA, 18 bp, Artificial Sequence
  Synthetic Polynucleotide
aaatgccgtcgtccaaaa

SEQ ID NO: 7258 - DNA, 19 bp, Artificial Sequence
  Synthetic Polynucleotide
tgcaggaaagagcgtaaga

SEQ ID NO: 7259 - DNA, 17 bp, Artificial Sequence
  Synthetic Polynucleotide
gtagacagcgttgaata

SEQ ID NO: 7260 - DNA, 17 bp, Artificial Sequence
  Synthetic Polynucleotide
aactcaagcgggtaggg

SEQ ID NO: 7261 - DNA, 20 bp, Artificial Sequence
  Synthetic Polynucleotide
agtcacttcgacaatcgttt

SEQ ID NO: 7262 - DNA, 18 bp, Artificial Sequence
  Synthetic Polynucleotide
atgaagaacagtctgacc

SEQ ID NO: 7263 - DNA, 17 bp, Artificial Sequence
  Synthetic Polynucleotide
tgcatgataaaggggtc

SEQ ID NO: 7264 - DNA, 20 bp, Artificial Sequence
  Synthetic Polynucleotide
aacagttggagtttcttggc

SEQ ID NO: 7265 - DNA, 19 bp, Artificial Sequence
  Synthetic Polynucleotide
cgtaactcggatcgtttgt

SEQ ID NO: 7266 - DNA, 19 bp, Artificial Sequence
  Synthetic Polynucleotide
atatctgaatcgagcgttt

SEQ ID NO: 7267 - DNA, 17 bp, Artificial Sequence
  Synthetic Polynucleotide
gaccacaatagggttcc

SEQ ID NO: 7268 - DNA, 20 bp, Artificial Sequence
  Synthetic Polynucleotide
gtgcgtatgctatcgaaatc

SEQ ID NO: 7269 - DNA, 18 bp, Artificial Sequence
  Synthetic Polynucleotide
ggcaacacaaaccataag

SEQ ID NO: 7270 - DNA, 19 bp, Artificial Sequence
  Synthetic Polynucleotide
cgaacataatgaacagagc

SEQ ID NO: 7271 - DNA, 20 bp, Artificial Sequence
  Synthetic Polynucleotide
tccataaatgcctaacaatt

SEQ ID NO: 7272 - DNA, 19 bp, Artificial Sequence
  Synthetic Polynucleotide
ctgtcacaaatgcaagaat

SEQ ID NO: 7273 - DNA, 17 bp, Artificial Sequence
  Synthetic Polynucleotide
ggtttagccatcccacg

SEQ ID NO: 7274 - DNA, 20 bp, Artificial Sequence
  Synthetic Polynucleotide
ccatcgtttcatcctacttc

SEQ ID NO: 7275 - DNA, 20 bp, Artificial Sequence
  Synthetic Polynucleotide
cctgaacagaaataacgggt

SEQ ID NO: 7276 - DNA, 20 bp, Artificial Sequence
  Synthetic Polynucleotide
taagagttatactgggaaag

SEQ ID NO: 7277 - DNA, 20 bp, Artificial Sequence
  Synthetic Polynucleotide
gtgataacacttctccatga

SEQ ID NO: 7278 - DNA, 20 bp, Artificial Sequence
  Synthetic Polynucleotide
taaatgccttctgaatgatc

SEQ ID NO: 7279 - DNA, 18 bp, Artificial Sequence
  Synthetic Polynucleotide
tcgaatggatacacagaa

SEQ ID NO: 7280 - DNA, 18 bp, Artificial Sequence
  Synthetic Polynucleotide
cacatcaacacacctaga

SEQ ID NO: 7281 - DNA, 20 bp, Artificial Sequence
  Synthetic Polynucleotide
tcttttcaagtccctgacca

SEQ ID NO: 7282 - DNA, 19 bp, Artificial Sequence
  Synthetic Polynucleotide
gcaacaacagtccatcact

SEQ ID NO: 7283 - DNA, 20 bp, Artificial Sequence
  Synthetic Polynucleotide
tcatcaagtacagtccagaa

SEQ ID NO: 7284 - DNA, 17 bp, Artificial Sequence
  Synthetic Polynucleotide
aacccaatccaccacag

SEQ ID NO: 7285 - DNA, 19 bp, Artificial Sequence
  Synthetic Polynucleotide
atgcatcgccatactgggt

SEQ ID NO: 7286 - DNA, 19 bp, Artificial Sequence
  Synthetic Polynucleotide
tggcatctccaatagttat

SEQ ID NO: 7287 - DNA, 18 bp, Artificial Sequence
  Synthetic Polynucleotide
tatcgggtttcttccatt

SEQ ID NO: 7288 - DNA, 17 bp, Artificial Sequence
  Synthetic Polynucleotide
atctcatgcgtaccaat

SEQ ID NO: 7289 - DNA, 20 bp, Artificial Sequence
  Synthetic Polynucleotide
gacaaatgatagcataccac

SEQ ID NO: 7290 - DNA, 17 bp, Artificial Sequence
  Synthetic Polynucleotide
gccccatcataagtgca

SEQ ID NO: 7291 - DNA, 19 bp, Artificial Sequence
  Synthetic Polynucleotide
gttgcctcagctagaattc

SEQ ID NO: 7292 - DNA, 17 bp, Artificial Sequence
  Synthetic Polynucleotide
gctgttccaatcgacta

SEQ ID NO: 7293 - DNA, 19 bp, Artificial Sequence
  Synthetic Polynucleotide
gacgtgctaacactaaata

SEQ ID NO: 7294 - DNA, 19 bp, Artificial Sequence
  Synthetic Polynucleotide
gcaccacagaatagagcag

SEQ ID NO: 7295 - DNA, 18 bp, Artificial Sequence
  Synthetic Polynucleotide
ggtcgtctcttgacaatt

SEQ ID NO: 7296 - DNA, 20 bp, Artificial Sequence
  Synthetic Polynucleotide
tcagacctccagaactccaa

SEQ ID NO: 7297 - DNA, 17 bp, Artificial Sequence
  Synthetic Polynucleotide
gcggtcattcccacaac

SEQ ID NO: 7298 - DNA, 19 bp, Artificial Sequence
  Synthetic Polynucleotide
atgatatcggctgtttcag

SEQ ID NO: 7299 - DNA, 17 bp, Artificial Sequence
  Synthetic Polynucleotide
gacaaaccttggccccg

SEQ ID NO: 7300 - DNA, 18 bp, Artificial Sequence
  Synthetic Polynucleotide
atgaaaggaaagcggttc

SEQ ID NO: 7301 - DNA, 19 bp, Artificial Sequence
  Synthetic Polynucleotide
acgtcagtacatatccaca

SEQ ID NO: 7302 - DNA, 20 bp, Artificial Sequence
  Synthetic Polynucleotide
tcatcttggcattttcatgc

SEQ ID NO: 7303 - DNA, 19 bp, Artificial Sequence
  Synthetic Polynucleotide
ctttgcggtatcgtcttct

SEQ ID NO: 7304 - DNA, 20 bp, Artificial Sequence
  Synthetic Polynucleotide
tcagactgtattaccaacat

SEQ ID NO: 7305 - DNA, 19 bp, Artificial Sequence
  Synthetic Polynucleotide
gtgttccagaacttcgcct

SEQ ID NO: 7306 - DNA, 20 bp, Artificial Sequence
  Synthetic Polynucleotide
tgcaatactaacaacgaaca

SEQ ID NO: 7307 - DNA, 18 bp, Artificial Sequence
  Synthetic Polynucleotide
aattcaccttgatcccca

SEQ ID NO: 7308 - DNA, 18 bp, Artificial Sequence
  Synthetic Polynucleotide
gagagaaaggaatttgcg

SEQ ID NO: 7309 - DNA, 18 bp, Artificial Sequence
  Synthetic Polynucleotide
tccaaccttccaataaca

SEQ ID NO: 7310 - DNA, 18 bp, Artificial Sequence
  Synthetic Polynucleotide
tgatcgttccctcgaaat

SEQ ID NO: 7311 - DNA, 19 bp, Artificial Sequence
  Synthetic Polynucleotide
tcgtcctcatcatctccca

SEQ ID NO: 7312 - DNA, 19 bp, Artificial Sequence
  Synthetic Polynucleotide
ttcagactattttgcttcg

SEQ ID NO: 7313 - DNA, 18 bp, Artificial Sequence
  Synthetic Polynucleotide
atctaaagcaggacagtt

SEQ ID NO: 7314 - DNA, 17 bp, Artificial Sequence
  Synthetic Polynucleotide
gtcacatcatccagggt

SEQ ID NO: 7315 - DNA, 18 bp, Artificial Sequence
  Synthetic Polynucleotide
ataaaccagcgagaaacg

SEQ ID NO: 7316 - DNA, 19 bp, Artificial Sequence
  Synthetic Polynucleotide
gctttctctttcggagttt

SEQ ID NO: 7317 - DNA, 18 bp, Artificial Sequence
  Synthetic Polynucleotide
ctccaagtatcttgcacc

SEQ ID NO: 7318 - DNA, 19 bp, Artificial Sequence
  Synthetic Polynucleotide
gagattggtgagaggacac

SEQ ID NO: 7319 - DNA, 19 bp, Artificial Sequence
  Synthetic Polynucleotide
gcatttcctcctactccct

SEQ ID NO: 7320 - DNA, 20 bp, Artificial Sequence
  Synthetic Polynucleotide
agcaacgagtgatgacagca

SEQ ID NO: 7321 - DNA, 18 bp, Artificial Sequence
  Synthetic Polynucleotide
ttgctcctttgtgaagcc

SEQ ID NO: 7322 - DNA, 18 bp, Artificial Sequence
  Synthetic Polynucleotide
taaatcccgtccatctgg

SEQ ID NO: 7323 - DNA, 19 bp, Artificial Sequence
  Synthetic Polynucleotide
tttacgattgacagcgttt

SEQ ID NO: 7324 - DNA, 20 bp, Artificial Sequence
  Synthetic Polynucleotide
ctattcagtattaacgccca

SEQ ID NO: 7325 - DNA, 20 bp, Artificial Sequence
  Synthetic Polynucleotide
agatttcgttccattcatct

SEQ ID NO: 7326 - DNA, 19 bp, Artificial Sequence
  Synthetic Polynucleotide
tggaacatccaaacgacca

SEQ ID NO: 7327 - DNA, 17 bp, Artificial Sequence
  Synthetic Polynucleotide
aaagagtacccgcccag

SEQ ID NO: 7328 - DNA, 19 bp, Artificial Sequence
  Synthetic Polynucleotide
ctcttcccaaaataccctc

SEQ ID NO: 7329 - DNA, 18 bp, Artificial Sequence
  Synthetic Polynucleotide
cttgaaacttccagcagt

SEQ ID NO: 7330 - DNA, 19 bp, Artificial Sequence
  Synthetic Polynucleotide
gagcttgttatgtatggca

SEQ ID NO: 7331 - DNA, 20 bp, Artificial Sequence
  Synthetic Polynucleotide
gtatgtgaacaacaaccaga

SEQ ID NO: 7332 - DNA, 17 bp, Artificial Sequence
  Synthetic Polynucleotide
tcccatctctagcatcc

SEQ ID NO: 7333 - DNA, 19 bp, Artificial Sequence
  Synthetic Polynucleotide
catctttccaaataaccca

SEQ ID NO: 7334 - DNA, 17 bp, Artificial Sequence
  Synthetic Polynucleotide
taagtccagcgaataga

SEQ ID NO: 7335 - DNA, 20 bp, Artificial Sequence
  Synthetic Polynucleotide
ttgtatctctttgagacacc

SEQ ID NO: 7336 - DNA, 19 bp, Artificial Sequence
  Synthetic Polynucleotide
caggctctgattatgtata

SEQ ID NO: 7337 - DNA, 20 bp, Artificial Sequence
  Synthetic Polynucleotide
accgcctaaaatccaattgt

SEQ ID NO: 7338 - DNA, 19 bp, Artificial Sequence
  Synthetic Polynucleotide
cattccattttcaatgccc

SEQ ID NO: 7339 - DNA, 19 bp, Artificial Sequence
  Synthetic Polynucleotide
ggtctatgaccagcatgag

SEQ ID NO: 7340 - DNA, 19 bp, Artificial Sequence
  Synthetic Polynucleotide
ggcacctaaatttacccga

SEQ ID NO: 7341 - DNA, 17 bp, Artificial Sequence
  Synthetic Polynucleotide
tcaactgtttgcgatcc

SEQ ID NO: 7342 - DNA, 18 bp, Artificial Sequence
  Synthetic Polynucleotide
ttgacgatatccctgatg

SEQ ID NO: 7343 - DNA, 17 bp, Artificial Sequence
  Synthetic Polynucleotide
cagcacggctatcaaga

SEQ ID NO: 7344 - DNA, 20 bp, Artificial Sequence
  Synthetic Polynucleotide
atgtcagttttaataccgac

SEQ ID NO: 7345 - DNA, 19 bp, Artificial Sequence
  Synthetic Polynucleotide
tctttcagcttgtgtcgcc

SEQ ID NO: 7346 - DNA, 20 bp, Artificial Sequence
  Synthetic Polynucleotide
gctaaatgaatacaaagcta

SEQ ID NO: 7347 - DNA, 19 bp, Artificial Sequence
  Synthetic Polynucleotide
gcgtgtgctctgaatgtat

SEQ ID NO: 7348 - DNA, 20 bp, Artificial Sequence
  Synthetic Polynucleotide
gcgttacaaacagaggaaga

SEQ ID NO: 7349 - DNA, 20 bp, Artificial Sequence
  Synthetic Polynucleotide
tcttcgagtctcacctactc

SEQ ID NO: 7350 - DNA, 20 bp, Artificial Sequence
  Synthetic Polynucleotide
gttcatcagatttccgataa

SEQ ID NO: 7351 - DNA, 20 bp, Artificial Sequence
  Synthetic Polynucleotide
gtcaggttcatcaggaatct

SEQ ID NO: 7352 - DNA, 19 bp, Artificial Sequence
  Synthetic Polynucleotide
acctgtatccagtcattac

SEQ ID NO: 7353 - DNA, 18 bp, Artificial Sequence
  Synthetic Polynucleotide
ggtctcatcatttcggtt

SEQ ID NO: 7354 - DNA, 20 bp, Artificial Sequence
  Synthetic Polynucleotide
ccctggtttatcaaagcaaa

SEQ ID NO: 7355 - DNA, 19 bp, Artificial Sequence
  Synthetic Polynucleotide
tacttgccttccgatttcc

SEQ ID NO: 7356 - DNA, 20 bp, Artificial Sequence
  Synthetic Polynucleotide
aagacccgcatgtacaacac

SEQ ID NO: 7357 - DNA, 20 bp, Artificial Sequence
  Synthetic Polynucleotide
cgacttgtgtgtattaactg

SEQ ID NO: 7358 - DNA, 20 bp, Artificial Sequence
  Synthetic Polynucleotide
tgattgactctaactccaag

SEQ ID NO: 7359 - DNA, 18 bp, Artificial Sequence
  Synthetic Polynucleotide
ctcccactaccaattgct

SEQ ID NO: 7360 - DNA, 20 bp, Artificial Sequence
  Synthetic Polynucleotide
ggaattaaaagagaggagcg

SEQ ID NO: 7361 - DNA, 20 bp, Artificial Sequence
  Synthetic Polynucleotide
gtaggaatttgcatcgctgg

SEQ ID NO: 7362 - DNA, 20 bp, Artificial Sequence
  Synthetic Polynucleotide
agtcccgctagatggtttcg

SEQ ID NO: 7363 - DNA, 18 bp, Artificial Sequence
  Synthetic Polynucleotide
aggaggtcattacgttgg

SEQ ID NO: 7364 - DNA, 18 bp, Artificial Sequence
  Synthetic Polynucleotide
cgttcattgcccagttgc

SEQ ID NO: 7365 - DNA, 18 bp, Artificial Sequence
  Synthetic Polynucleotide
attcagtctttcccttca

SEQ ID NO: 7366 - DNA, 19 bp, Artificial Sequence
  Synthetic Polynucleotide
tatctcggctacccctatc

SEQ ID NO: 7367 - DNA, 20 bp, Artificial Sequence
  Synthetic Polynucleotide
taagcccttaacatattccc

SEQ ID NO: 7368 - DNA, 20 bp, Artificial Sequence
  Synthetic Polynucleotide
tcaaagatagtttccttccg

SEQ ID NO: 7369 - DNA, 19 bp, Artificial Sequence
  Synthetic Polynucleotide
tcccgtacaatctaaactt

SEQ ID NO: 7370 - DNA, 18 bp, Artificial Sequence
  Synthetic Polynucleotide
tcgtgttcctaagattga

SEQ ID NO: 7371 - DNA, 20 bp, Artificial Sequence
  Synthetic Polynucleotide
tttcgatatcacctcgcatt

SEQ ID NO: 7372 - DNA, 20 bp, Artificial Sequence
  Synthetic Polynucleotide
ttagatccacttaccaaagt

SEQ ID NO: 7373 - DNA, 18 bp, Artificial Sequence
  Synthetic Polynucleotide
ctgctgtatttccccggc

SEQ ID NO: 7374 - DNA, 17 bp, Artificial Sequence
  Synthetic Polynucleotide
cccgcttcaaacataga

SEQ ID NO: 7375 - DNA, 20 bp, Artificial Sequence
  Synthetic Polynucleotide
gtaactcaaggtggtatgcc

SEQ ID NO: 7376 - DNA, 20 bp, Artificial Sequence
  Synthetic Polynucleotide
tatcatcgttttatcctctg

SEQ ID NO: 7377 - DNA, 19 bp, Artificial Sequence
  Synthetic Polynucleotide
ggtaacatgcgtacaggat

SEQ ID NO: 7378 - DNA, 20 bp, Artificial Sequence
  Synthetic Polynucleotide
ccatttcctttgtcacacgt

SEQ ID NO: 7379 - DNA, 19 bp, Artificial Sequence
  Synthetic Polynucleotide
cttcgtaacaatcatacga

SEQ ID NO: 7380 - DNA, 18 bp, Artificial Sequence
  Synthetic Polynucleotide
gtgaagcgagaagcaacg

SEQ ID NO: 7381 - DNA, 19 bp, Artificial Sequence
  Synthetic Polynucleotide
atctgctgatttaagccta

SEQ ID NO: 7382 - DNA, 18 bp, Artificial Sequence
  Synthetic Polynucleotide
cgctgatgcgtagtcgta

SEQ ID NO: 7383 - DNA, 19 bp, Artificial Sequence
  Synthetic Polynucleotide
actggaaccaacattgcgt

SEQ ID NO: 7384 - DNA, 19 bp, Artificial Sequence
  Synthetic Polynucleotide
tgatcgaagagtggagagc

SEQ ID NO: 7385 - DNA, 18 bp, Artificial Sequence
  Synthetic Polynucleotide
aggtacttttaggtgcgg

SEQ ID NO: 7386 - DNA, 20 bp, Artificial Sequence
  Synthetic Polynucleotide
ccgtcattctggactttaaa

SEQ ID NO: 7387 - DNA, 20 bp, Artificial Sequence
  Synthetic Polynucleotide
tacgttcaaaaccaatatgt

SEQ ID NO: 7388 - DNA, 19 bp, Artificial Sequence
  Synthetic Polynucleotide
acttgatgaagatgacccg

SEQ ID NO: 7389 - DNA, 19 bp, Artificial Sequence
  Synthetic Polynucleotide
cacttttgggagtcaaatc

SEQ ID NO: 7390 - DNA, 18 bp, Artificial Sequence
  Synthetic Polynucleotide
agcattgtcggccttacc

SEQ ID NO: 7391 - DNA, 18 bp, Artificial Sequence
  Synthetic Polynucleotide
cagctttacccgtggcgt

SEQ ID NO: 7392 - DNA, 20 bp, Artificial Sequence
  Synthetic Polynucleotide
ttgctggacttatctttgcc

SEQ ID NO: 7393 - DNA, 20 bp, Artificial Sequence
  Synthetic Polynucleotide
gagtagtcaaattgtcggct

SEQ ID NO: 7394 - DNA, 20 bp, Artificial Sequence
  Synthetic Polynucleotide
cggttagttcaactcatagt

SEQ ID NO: 7395 - DNA, 18 bp, Artificial Sequence
  Synthetic Polynucleotide
aaatcaaattgctgtgga

SEQ ID NO: 7396 - DNA, 19 bp, Artificial Sequence
  Synthetic Polynucleotide
actagccatagtgaatacg

SEQ ID NO: 7397 - DNA, 19 bp, Artificial Sequence
  Synthetic Polynucleotide
gatcgaccctaacttctat

SEQ ID NO: 7398 - DNA, 18 bp, Artificial Sequence
  Synthetic Polynucleotide
tgaatttcaacagtgggc

SEQ ID NO: 7399 - DNA, 17 bp, Artificial Sequence
  Synthetic Polynucleotide
acaggacagggactggc

SEQ ID NO: 7400 - DNA, 18 bp, Artificial Sequence
  Synthetic Polynucleotide
tcatacgtcatttgtgct

SEQ ID NO: 7401 - DNA, 18 bp, Artificial Sequence
  Synthetic Polynucleotide
cggaagtagtaacaacgt

SEQ ID NO: 7402 - DNA, 19 bp, Artificial Sequence
  Synthetic Polynucleotide
cgaagaaatattactggcg

SEQ ID NO: 7403 - DNA, 18 bp, Artificial Sequence
  Synthetic Polynucleotide
gagacctcaacgtctaga

SEQ ID NO: 7404 - DNA, 18 bp, Artificial Sequence
  Synthetic Polynucleotide
tgtcttgtattgtcggca

SEQ ID NO: 7405 - DNA, 20 bp, Artificial Sequence
  Synthetic Polynucleotide
tatattgcattgagcatggg

SEQ ID NO: 7406 - DNA, 19 bp, Artificial Sequence
  Synthetic Polynucleotide
ttcatcacaaatcacgatg

SEQ ID NO: 7407 - DNA, 17 bp, Artificial Sequence
  Synthetic Polynucleotide
caccattagcacacgaa

SEQ ID NO: 7408 - DNA, 20 bp, Artificial Sequence
  Synthetic Polynucleotide
tttgaacagagtacgataca

SEQ ID NO: 7409 - DNA, 20 bp, Artificial Sequence
  Synthetic Polynucleotide
ccaagcactcaacctcctct

SEQ ID NO: 7410 - DNA, 17 bp, Artificial Sequence
  Synthetic Polynucleotide
gtctgagcgggtttgtt

SEQ ID NO: 7411 - DNA, 20 bp, Artificial Sequence
  Synthetic Polynucleotide
gttgacttaacaaccacact

SEQ ID NO: 7412 - DNA, 19 bp, Artificial Sequence
  Synthetic Polynucleotide
aacacatctgaagctgtca

SEQ ID NO: 7413 - DNA, 17 bp, Artificial Sequence
  Synthetic Polynucleotide
ttagcatgtctgaacgc

SEQ ID NO: 7414 - DNA, 20 bp, Artificial Sequence
  Synthetic Polynucleotide
tggataggaacgactcacgc

SEQ ID NO: 7415 - DNA, 20 bp, Artificial Sequence
  Synthetic Polynucleotide
agttgtgtaactacgtctat

SEQ ID NO: 7416 - DNA, 20 bp, Artificial Sequence
  Synthetic Polynucleotide
tagatgccagtcttgaacac

SEQ ID NO: 7417 - DNA, 18 bp, Artificial Sequence
  Synthetic Polynucleotide
agtgatatacctttcccg

SEQ ID NO: 7418 - DNA, 20 bp, Artificial Sequence
  Synthetic Polynucleotide
ttaaagatgggaacgatgag

SEQ ID NO: 7419 - DNA, 19 bp, Artificial Sequence
  Synthetic Polynucleotide
aagcaacaccaattagatc

SEQ ID NO: 7420 - DNA, 20 bp, Artificial Sequence
  Synthetic Polynucleotide
aaacgattagagttggaaaa

SEQ ID NO: 7421 - DNA, 20 bp, Artificial Sequence
  Synthetic Polynucleotide
ctgccattattgagttagtc

SEQ ID NO: 7422 - DNA, 17 bp, Artificial Sequence
  Synthetic Polynucleotide
atcagcacccacaattg

SEQ ID NO: 7423 - DNA, 20 bp, Artificial Sequence
  Synthetic Polynucleotide
acataacatactgacctctt

SEQ ID NO: 7424 - DNA, 19 bp, Artificial Sequence
  Synthetic Polynucleotide
caattgcataacgagaaag

SEQ ID NO: 7425 - DNA, 20 bp, Artificial Sequence
  Synthetic Polynucleotide
catcatatctaagcacatga

SEQ ID NO: 7426 - DNA, 17 bp, Artificial Sequence
  Synthetic Polynucleotide
tgtgccactttacaaga

SEQ ID NO: 7427 - DNA, 19 bp, Artificial Sequence
  Synthetic Polynucleotide
agtacacctatgatacgga

SEQ ID NO: 7428 - DNA, 20 bp, Artificial Sequence
  Synthetic Polynucleotide
ttgaaagaaagtctgaagcc

SEQ ID NO: 7429 - DNA, 19 bp, Artificial Sequence
  Synthetic Polynucleotide
tcttctctccattcaacta

SEQ ID NO: 7430 - DNA, 18 bp, Artificial Sequence
  Synthetic Polynucleotide
gagatggaactgcacctt

SEQ ID NO: 7431 - DNA, 20 bp, Artificial Sequence
  Synthetic Polynucleotide
atatgtctaagtttaaccgg

SEQ ID NO: 7432 - DNA, 20 bp, Artificial Sequence
  Synthetic Polynucleotide
gtaacctccaagttcataat

SEQ ID NO: 7433 - DNA, 19 bp, Artificial Sequence
  Synthetic Polynucleotide
tgcaaatttcttctcttcc

SEQ ID NO: 7434 - DNA, 17 bp, Artificial Sequence
  Synthetic Polynucleotide
acagaaacgaacaaggg

SEQ ID NO: 7435 - DNA, 19 bp, Artificial Sequence
  Synthetic Polynucleotide
cgcagtttgaaggaggcat

SEQ ID NO: 7436 - DNA, 19 bp, Artificial Sequence
  Synthetic Polynucleotide
agtgctttggccctcgtag

SEQ ID NO: 7437 - DNA, 20 bp, Artificial Sequence
  Synthetic Polynucleotide
aagaatatagtggaagggtg

SEQ ID NO: 7438 - DNA, 19 bp, Artificial Sequence
  Synthetic Polynucleotide
aatcgcccaagtatatggt

SEQ ID NO: 7439 - DNA, 20 bp, Artificial Sequence
  Synthetic Polynucleotide
ctaatctttctgcatgagac

SEQ ID NO: 7440 - DNA, 18 bp, Artificial Sequence
  Synthetic Polynucleotide
taaattgcacgtcggtcc

SEQ ID NO: 7441 - DNA, 19 bp, Artificial Sequence
  Synthetic Polynucleotide
atacattcagcgttaacct

SEQ ID NO: 7442 - DNA, 18 bp, Artificial Sequence
  Synthetic Polynucleotide
agcggtaagtcttggttg

SEQ ID NO: 7443 - DNA, 18 bp, Artificial Sequence
  Synthetic Polynucleotide
tagtgtggcaggtcgtac

SEQ ID NO: 7444 - DNA, 20 bp, Artificial Sequence
  Synthetic Polynucleotide
gttgagaaacaaatgtctgc

SEQ ID NO: 7445 - DNA, 20 bp, Artificial Sequence
  Synthetic Polynucleotide
cgttcatctacctctcataa

SEQ ID NO: 7446 - DNA, 20 bp, Artificial Sequence
  Synthetic Polynucleotide
caatctaagtggtctgctaa

SEQ ID NO: 7447 - DNA, 17 bp, Artificial Sequence
  Synthetic Polynucleotide
gtcacctcgggttagga

SEQ ID NO: 7448 - DNA, 19 bp, Artificial Sequence
  Synthetic Polynucleotide
gactggtgttaagtatcgc

SEQ ID NO: 7449 - DNA, 18 bp, Artificial Sequence
  Synthetic Polynucleotide
tagaagatgtttagccct

SEQ ID NO: 7450 - DNA, 20 bp, Artificial Sequence
  Synthetic Polynucleotide
agagtccgttctatgtgatt

SEQ ID NO: 7451 - DNA, 19 bp, Artificial Sequence
  Synthetic Polynucleotide
taatgtcatcaagaatcgg

SEQ ID NO: 7452 - DNA, 19 bp, Artificial Sequence
  Synthetic Polynucleotide
cggagatacgtcatcactt

SEQ ID NO: 7453 - DNA, 19 bp, Artificial Sequence
  Synthetic Polynucleotide
gcgaattcatctaggtcag

SEQ ID NO: 7454 - DNA, 17 bp, Artificial Sequence
  Synthetic Polynucleotide
ccctggtctcgtttcac

SEQ ID NO: 7455 - DNA, 18 bp, Artificial Sequence
  Synthetic Polynucleotide
cgttcttaatgcgtagta

SEQ ID NO: 7456 - DNA, 18 bp, Artificial Sequence
  Synthetic Polynucleotide
ggggtctttctgtctctg

SEQ ID NO: 7457 - DNA, 17 bp, Artificial Sequence
  Synthetic Polynucleotide
tcagtaagtctgctcga

SEQ ID NO: 7458 - DNA, 20 bp, Artificial Sequence
  Synthetic Polynucleotide
gcatacacaaagttgattca

SEQ ID NO: 7459 - DNA, 18 bp, Artificial Sequence
  Synthetic Polynucleotide
tgctggtaagttgaagca

SEQ ID NO: 7460 - DNA, 17 bp, Artificial Sequence
  Synthetic Polynucleotide
attggcatgatggagct

SEQ ID NO: 7461 - DNA, 18 bp, Artificial Sequence
  Synthetic Polynucleotide
gtacaagtagctgtggtt

SEQ ID NO: 7462 - DNA, 20 bp, Artificial Sequence
  Synthetic Polynucleotide
cgctctcacaattatttctg

SEQ ID NO: 7463 - DNA, 20 bp, Artificial Sequence
  Synthetic Polynucleotide
gaggaacatttcactgaagc

SEQ ID NO: 7464 - DNA, 18 bp, Artificial Sequence
  Synthetic Polynucleotide
acctggagtctaagtacg

SEQ ID NO: 7465 - DNA, 17 bp, Artificial Sequence
  Synthetic Polynucleotide
gtgcatagagtggctgc

SEQ ID NO: 7466 - DNA, 20 bp, Artificial Sequence
  Synthetic Polynucleotide
aattttaattaccgactgcc

SEQ ID NO: 7467 - DNA, 20 bp, Artificial Sequence
  Synthetic Polynucleotide
gacgtataccataacacttc

SEQ ID NO: 7468 - DNA, 20 bp, Artificial Sequence
  Synthetic Polynucleotide
atattgctgaagtgtgtatg

SEQ ID NO: 7469 - DNA, 17 bp, Artificial Sequence
  Synthetic Polynucleotide
ttcaagtgcgaccgaca

SEQ ID NO: 7470 - DNA, 17 bp, Artificial Sequence
  Synthetic Polynucleotide
tcattaaggtagaggcg

SEQ ID NO: 7471 - DNA, 19 bp, Artificial Sequence
  Synthetic Polynucleotide
tactttcattttcaccgtt

SEQ ID NO: 7472 - DNA, 20 bp, Artificial Sequence
  Synthetic Polynucleotide
agagggaattgaagtaacaa

SEQ ID NO: 7473 - DNA, 19 bp, Artificial Sequence
  Synthetic Polynucleotide
actgtcatcaagctcgtct

SEQ ID NO: 7474 - DNA, 17 bp, Artificial Sequence
  Synthetic Polynucleotide
acccaaacttaccgaaa

SEQ ID NO: 7475 - DNA, 19 bp, Artificial Sequence
  Synthetic Polynucleotide
ctcgctcccgataaccaat

SEQ ID NO: 7476 - DNA, 18 bp, Artificial Sequence
  Synthetic Polynucleotide
acgaaactgctcctttga

SEQ ID NO: 7477 - DNA, 19 bp, Artificial Sequence
  Synthetic Polynucleotide
agagggtggttgacatccc

SEQ ID NO: 7478 - DNA, 20 bp, Artificial Sequence
  Synthetic Polynucleotide
aagaccaacatggatgtact

SEQ ID NO: 7479 - DNA, 20 bp, Artificial Sequence
  Synthetic Polynucleotide
ctgataacacagtagtgacc

SEQ ID NO: 7480 - DNA, 19 bp, Artificial Sequence
  Synthetic Polynucleotide
agctttaccagacaatgag

SEQ ID NO: 7481 - DNA, 19 bp, Artificial Sequence
  Synthetic Polynucleotide
ggatctccgtcaaagtgat

SEQ ID NO: 7482 - DNA, 18 bp, Artificial Sequence
  Synthetic Polynucleotide
cgatgccctgtaatcgcg

SEQ ID NO: 7483 - DNA, 17 bp, Artificial Sequence
  Synthetic Polynucleotide
ctgtggcttctcagtca

SEQ ID NO: 7484 - DNA, 18 bp, Artificial Sequence
  Synthetic Polynucleotide
aaacatcaaaacgctaga

SEQ ID NO: 7485 - DNA, 20 bp, Artificial Sequence
  Synthetic Polynucleotide
tatgggttctctcgtattta

SEQ ID NO: 7486 - DNA, 18 bp, Artificial Sequence
  Synthetic Polynucleotide
ggtcccttaaagtacgaa

SEQ ID NO: 7487 - DNA, 20 bp, Artificial Sequence
  Synthetic Polynucleotide
ctcttatctgcttcattacc

SEQ ID NO: 7488 - DNA, 18 bp, Artificial Sequence
  Synthetic Polynucleotide
aagcacatagtgactacg

SEQ ID NO: 7489 - DNA, 19 bp, Artificial Sequence
  Synthetic Polynucleotide
acagagtcattctcaaaca

SEQ ID NO: 7490 - DNA, 17 bp, Artificial Sequence
  Synthetic Polynucleotide
ggtgaccccttctaacg

SEQ ID NO: 7491 - DNA, 17 bp, Artificial Sequence
  Synthetic Polynucleotide
aggagctgaccacacta

SEQ ID NO: 7492 - DNA, 17 bp, Artificial Sequence
  Synthetic Polynucleotide
gcaaaatgtgccaatta

SEQ ID NO: 7493 - DNA, 18 bp, Artificial Sequence
  Synthetic Polynucleotide
ggacgttactcaatgtgt

SEQ ID NO: 7494 - DNA, 18 bp, Artificial Sequence
  Synthetic Polynucleotide
gtgtcctccgtgatgggt

SEQ ID NO: 7495 - DNA, 18 bp, Artificial Sequence
  Synthetic Polynucleotide
ggttaaacgggattaagg

SEQ ID NO: 7496 - DNA, 20 bp, Artificial Sequence
  Synthetic Polynucleotide
taaaagttctgttccgagag

SEQ ID NO: 7497 - DNA, 19 bp, Artificial Sequence
  Synthetic Polynucleotide
ggcttaagggattagggca

SEQ ID NO: 7498 - DNA, 17 bp, Artificial Sequence
  Synthetic Polynucleotide
cagcaagagctacaagc

SEQ ID NO: 7499 - DNA, 20 bp, Artificial Sequence
  Synthetic Polynucleotide
gtgtcacactacgcatgtca

SEQ ID NO: 7500 - DNA, 19 bp, Artificial Sequence
  Synthetic Polynucleotide
gatgcaagatggatggtgt

SEQ ID NO: 7501 - DNA, 20 bp, Artificial Sequence
  Synthetic Polynucleotide
cttatcatacgcctcgcatg

SEQ ID NO: 7502 - DNA, 20 bp, Artificial Sequence
  Synthetic Polynucleotide
acgatgtcttcttctttcac

SEQ ID NO: 7503 - DNA, 18 bp, Artificial Sequence
  Synthetic Polynucleotide
ctagtgaacccacttcca

SEQ ID NO: 7504 - DNA, 20 bp, Artificial Sequence
  Synthetic Polynucleotide
gagcagacgtaataataaga

SEQ ID NO: 7505 - DNA, 20 bp, Artificial Sequence
  Synthetic Polynucleotide
cagatagagacggcattata

SEQ ID NO: 7506 - DNA, 19 bp, Artificial Sequence
  Synthetic Polynucleotide
cgaaagtatgctactgaac

SEQ ID NO: 7507 - DNA, 20 bp, Artificial Sequence
  Synthetic Polynucleotide
gtatctgtgtaagtttacgc

SEQ ID NO: 7508 - DNA, 20 bp, Artificial Sequence
  Synthetic Polynucleotide
gggtccatttcaagtgttaa

SEQ ID NO: 7509 - DNA, 17 bp, Artificial Sequence
  Synthetic Polynucleotide
ctctttctgtcgccaat

SEQ ID NO: 7510 - DNA, 19 bp, Artificial Sequence
  Synthetic Polynucleotide
cgagtatcaacaatgacac

SEQ ID NO: 7511 - DNA, 17 bp, Artificial Sequence
  Synthetic Polynucleotide
actgacgcttaccaacc

SEQ ID NO: 7512 - DNA, 20 bp, Artificial Sequence
  Synthetic Polynucleotide
atgtatggtatcaaactacg

SEQ ID NO: 7513 - DNA, 18 bp, Artificial Sequence
  Synthetic Polynucleotide
agagaacaagctacgacc

SEQ ID NO: 7514 - DNA, 20 bp, Artificial Sequence
  Synthetic Polynucleotide
gatatcaattagctagaccg

SEQ ID NO: 7515 - DNA, 20 bp, Artificial Sequence
  Synthetic Polynucleotide
actcaactcaatatgcaaca

SEQ ID NO: 7516 - DNA, 18 bp, Artificial Sequence
  Synthetic Polynucleotide
gtgatccaatcgcctaaa

SEQ ID NO: 7517 - DNA, 17 bp, Artificial Sequence
  Synthetic Polynucleotide
gtatccgctttcctcga

SEQ ID NO: 7518 - DNA, 19 bp, Artificial Sequence
  Synthetic Polynucleotide
agagattccaaatagacgc

SEQ ID NO: 7519 - DNA, 20 bp, Artificial Sequence
  Synthetic Polynucleotide
ttaccgccttcattaatagt

SEQ ID NO: 7520 - DNA, 19 bp, Artificial Sequence
  Synthetic Polynucleotide
acgcaatagtatctgagac

SEQ ID NO: 7521 - DNA, 18 bp, Artificial Sequence
  Synthetic Polynucleotide
tctatctctttcgccata

SEQ ID NO: 7522 - DNA, 20 bp, Artificial Sequence
  Synthetic Polynucleotide
cctcaaataccttttgtctc

SEQ ID NO: 7523 - DNA, 20 bp, Artificial Sequence
  Synthetic Polynucleotide
ttgatcacttccaaaacatc

SEQ ID NO: 7524 - DNA, 20 bp, Artificial Sequence
  Synthetic Polynucleotide
tgatcatttctttgctgata

SEQ ID NO: 7525 - DNA, 19 bp, Artificial Sequence
  Synthetic Polynucleotide
attctcccaaaggagcaat

SEQ ID NO: 7526 - DNA, 20 bp, Artificial Sequence
  Synthetic Polynucleotide
tggtggaatagtcatagatt

SEQ ID NO: 7527 - DNA, 18 bp, Artificial Sequence
  Synthetic Polynucleotide
ccaggttgacgcagatga

SEQ ID NO: 7528 - DNA, 19 bp, Artificial Sequence
  Synthetic Polynucleotide
tacttccaacttgacgatc

SEQ ID NO: 7529 - DNA, 18 bp, Artificial Sequence
  Synthetic Polynucleotide
taattctattcgctggcc

SEQ ID NO: 7530 - DNA, 19 bp, Artificial Sequence
  Synthetic Polynucleotide
tggggcattcaatggagga

SEQ ID NO: 7531 - DNA, 19 bp, Artificial Sequence
  Synthetic Polynucleotide
aggtcgctaatcatacatt

SEQ ID NO: 7532 - DNA, 20 bp, Artificial Sequence
  Synthetic Polynucleotide
tatgaaaacacaatcaactg

SEQ ID NO: 7533 - DNA, 18 bp, Artificial Sequence
  Synthetic Polynucleotide
acgtatctcttgcactac

SEQ ID NO: 7534 - DNA, 18 bp, Artificial Sequence
  Synthetic Polynucleotide
ctggaacgctagaaacgt

SEQ ID NO: 7535 - DNA, 18 bp, Artificial Sequence
  Synthetic Polynucleotide
gtttgaagcagaatcaga

SEQ ID NO: 7536 - DNA, 20 bp, Artificial Sequence
  Synthetic Polynucleotide
tctggaaaatctattggtag

SEQ ID NO: 7537 - DNA, 19 bp, Artificial Sequence
  Synthetic Polynucleotide
cacatgcaacatcgccatc

SEQ ID NO: 7538 - DNA, 18 bp, Artificial Sequence
  Synthetic Polynucleotide
tcgcaatcttcggatgta

SEQ ID NO: 7539 - DNA, 20 bp, Artificial Sequence
  Synthetic Polynucleotide
cgcattcatatcaatgacgc

SEQ ID NO: 7540 - DNA, 18 bp, Artificial Sequence
  Synthetic Polynucleotide
gacacttcgcactctctc

SEQ ID NO: 7541 - DNA, 19 bp, Artificial Sequence
  Synthetic Polynucleotide
gcggtatattgtttggtag

SEQ ID NO: 7542 - DNA, 20 bp, Artificial Sequence
  Synthetic Polynucleotide
acccagtatccatcattaca

SEQ ID NO: 7543 - DNA, 20 bp, Artificial Sequence
  Synthetic Polynucleotide
cggtatcgacataacaggtc

SEQ ID NO: 7544 - DNA, 19 bp, Artificial Sequence
  Synthetic Polynucleotide
gaaataacacggtacgcag

SEQ ID NO: 7545 - DNA, 20 bp, Artificial Sequence
  Synthetic Polynucleotide
ctggaggtagtagtaatcta

SEQ ID NO: 7546 - DNA, 20 bp, Artificial Sequence
  Synthetic Polynucleotide
ttatttgtagccaaggatga

SEQ ID NO: 7547 - DNA, 18 bp, Artificial Sequence
  Synthetic Polynucleotide
ggggtaacacattcagga

SEQ ID NO: 7548 - DNA, 20 bp, Artificial Sequence
  Synthetic Polynucleotide
cttttgagtcatcatgttta

SEQ ID NO: 7549 - DNA, 19 bp, Artificial Sequence
  Synthetic Polynucleotide
acaatcacacaacacttgg

SEQ ID NO: 7550 - DNA, 20 bp, Artificial Sequence
  Synthetic Polynucleotide
tggttcgctacttacactat

SEQ ID NO: 7551 - DNA, 19 bp, Artificial Sequence
  Synthetic Polynucleotide
actccttcaggtttatgat

SEQ ID NO: 7552 - DNA, 19 bp, Artificial Sequence
  Synthetic Polynucleotide
tccgaagagatgactaata

SEQ ID NO: 7553 - DNA, 20 bp, Artificial Sequence
  Synthetic Polynucleotide
tacacgagaccgaaagtacc

SEQ ID NO: 7554 - DNA, 18 bp, Artificial Sequence
  Synthetic Polynucleotide
gtcaatccgacaactgcc

SEQ ID NO: 7555 - DNA, 20 bp, Artificial Sequence
  Synthetic Polynucleotide
tactaacaacaggtcaatgc

SEQ ID NO: 7556 - DNA, 20 bp, Artificial Sequence
  Synthetic Polynucleotide
gctacatttagggacaagaa

SEQ ID NO: 7557 - DNA, 20 bp, Artificial Sequence
  Synthetic Polynucleotide
ccaatcagattttgcaggag

SEQ ID NO: 7558 - DNA, 18 bp, Artificial Sequence
  Synthetic Polynucleotide
tattgcgtctccacctaa

SEQ ID NO: 7559 - DNA, 20 bp, Artificial Sequence
  Synthetic Polynucleotide
ataattctaccatttgtgca

SEQ ID NO: 7560 - DNA, 18 bp, Artificial Sequence
  Synthetic Polynucleotide
agtcagaacgtccgaaaa

SEQ ID NO: 7561 - DNA, 19 bp, Artificial Sequence
  Synthetic Polynucleotide
tccataatcaatgaggatg

SEQ ID NO: 7562 - DNA, 17 bp, Artificial Sequence
  Synthetic Polynucleotide
gcaggaaaaggaagtga

SEQ ID NO: 7563 - DNA, 20 bp, Artificial Sequence
  Synthetic Polynucleotide
actcaccttacaattacgta

SEQ ID NO: 7564 - DNA, 19 bp, Artificial Sequence
  Synthetic Polynucleotide
ttaccatcatatcagccac

SEQ ID NO: 7565 - DNA, 20 bp, Artificial Sequence
  Synthetic Polynucleotide
ggtgctgccatagccaaatt

SEQ ID NO: 7566 - DNA, 19 bp, Artificial Sequence
  Synthetic Polynucleotide
atcccactgtgctcacgaa

SEQ ID NO: 7567 - DNA, 17 bp, Artificial Sequence
  Synthetic Polynucleotide
atgtgaacatcagcgag

SEQ ID NO: 7568 - DNA, 20 bp, Artificial Sequence
  Synthetic Polynucleotide
aggatcaatgagttcaccat

SEQ ID NO: 7569 - DNA, 20 bp, Artificial Sequence
  Synthetic Polynucleotide
cctcccagtatcgccttaga

SEQ ID NO: 7570 - DNA, 19 bp, Artificial Sequence
  Synthetic Polynucleotide
ggaggaagaatcaatgccg

SEQ ID NO: 7571 - DNA, 20 bp, Artificial Sequence
  Synthetic Polynucleotide
gtaaaggaacgtcgaatgaa

SEQ ID NO: 7572 - DNA, 20 bp, Artificial Sequence
  Synthetic Polynucleotide
ccagtaaaagaaatacccag

SEQ ID NO: 7573 - DNA, 19 bp, Artificial Sequence
  Synthetic Polynucleotide
ccaaggttactaccaaggg

SEQ ID NO: 7574 - DNA, 18 bp, Artificial Sequence
  Synthetic Polynucleotide
tctgaattgaatcatcga

SEQ ID NO: 7575 - DNA, 18 bp, Artificial Sequence
  Synthetic Polynucleotide
aacaagcgaaagcccaac

SEQ ID NO: 7576 - DNA, 19 bp, Artificial Sequence
  Synthetic Polynucleotide
tactctagaccaatttcag

SEQ ID NO: 7577 - DNA, 18 bp, Artificial Sequence
  Synthetic Polynucleotide
tatttccacccaagtgca

SEQ ID NO: 7578 - DNA, 17 bp, Artificial Sequence
  Synthetic Polynucleotide
ccaacagaatacacgcc

SEQ ID NO: 7579 - DNA, 19 bp, Artificial Sequence
  Synthetic Polynucleotide
atgctctctccaagccatt

SEQ ID NO: 7580 - DNA, 20 bp, Artificial Sequence
  Synthetic Polynucleotide
cacattaaggattccaaact

SEQ ID NO: 7581 - DNA, 20 bp, Artificial Sequence
  Synthetic Polynucleotide
tatgagtcgtacactacccc

SEQ ID NO: 7582 - DNA, 17 bp, Artificial Sequence
  Synthetic Polynucleotide
agtgttcagtggacttg

SEQ ID NO: 7583 - DNA, 17 bp, Artificial Sequence
  Synthetic Polynucleotide
gtgtggagagtaagggt

SEQ ID NO: 7584 - DNA, 20 bp, Artificial Sequence
  Synthetic Polynucleotide
ttagaagacatcggagcagg

SEQ ID NO: 7585 - DNA, 20 bp, Artificial Sequence
  Synthetic Polynucleotide
tcccaaatgccataccaatc

SEQ ID NO: 7586 - DNA, 20 bp, Artificial Sequence
  Synthetic Polynucleotide
tatacaatacctcagaatcg

SEQ ID NO: 7587 - DNA, 17 bp, Artificial Sequence
  Synthetic Polynucleotide
gtgctggagttgttcat

SEQ ID NO: 7588 - DNA, 19 bp, Artificial Sequence
  Synthetic Polynucleotide
tcaagagctataccaacca

SEQ ID NO: 7589 - DNA, 18 bp, Artificial Sequence
  Synthetic Polynucleotide
gtcggtcctatttcaacg

SEQ ID NO: 7590 - DNA, 19 bp, Artificial Sequence
  Synthetic Polynucleotide
gattgagttctctaaacga

SEQ ID NO: 7591 - DNA, 17 bp, Artificial Sequence
  Synthetic Polynucleotide
tcattcaaacacgcacg

SEQ ID NO: 7592 - DNA, 19 bp, Artificial Sequence
  Synthetic Polynucleotide
aagaaggtctcctccctgt

SEQ ID NO: 7593 - DNA, 20 bp, Artificial Sequence
  Synthetic Polynucleotide
tcgctgtatttgtggtaata

SEQ ID NO: 7594 - DNA, 20 bp, Artificial Sequence
  Synthetic Polynucleotide
tattgcatcaccttttgtta

SEQ ID NO: 7595 - DNA, 18 bp, Artificial Sequence
  Synthetic Polynucleotide
ttcctcgccaaaacaatc

SEQ ID NO: 7596 - DNA, 20 bp, Artificial Sequence
  Synthetic Polynucleotide
gaaaagtcagttacaggcaa

SEQ ID NO: 7597 - DNA, 19 bp, Artificial Sequence
  Synthetic Polynucleotide
ccaattcaacacgagatct

SEQ ID NO: 7598 - DNA, 17 bp, Artificial Sequence
  Synthetic Polynucleotide
ggaacgcttatggtttg

SEQ ID NO: 7599 - DNA, 17 bp, Artificial Sequence
  Synthetic Polynucleotide
ggacactatcgctgcaa

SEQ ID NO: 7600 - DNA, 17 bp, Artificial Sequence
  Synthetic Polynucleotide
gcgccatcgcaaagttt

SEQ ID NO: 7601 - DNA, 18 bp, Artificial Sequence
  Synthetic Polynucleotide
ccttagaaagtttggagc

SEQ ID NO: 7602 - DNA, 17 bp, Artificial Sequence
  Synthetic Polynucleotide
cgaacctcaagttacgt

SEQ ID NO: 7603 - DNA, 19 bp, Artificial Sequence
  Synthetic Polynucleotide
aagtttctgtactagctgg

SEQ ID NO: 7604 - DNA, 17 bp, Artificial Sequence
  Synthetic Polynucleotide
gcgccattctcttcatt

SEQ ID NO: 7605 - DNA, 20 bp, Artificial Sequence
  Synthetic Polynucleotide
agtcttatctttgatcgctt

SEQ ID NO: 7606 - DNA, 20 bp, Artificial Sequence
  Synthetic Polynucleotide
ggtatactattcgcaagctg

SEQ ID NO: 7607 - DNA, 20 bp, Artificial Sequence
  Synthetic Polynucleotide
ttgtgtcggattatgcacat

SEQ ID NO: 7608 - DNA, 18 bp, Artificial Sequence
  Synthetic Polynucleotide
tcagccttatggtttctt

SEQ ID NO: 7609 - DNA, 17 bp, Artificial Sequence
  Synthetic Polynucleotide
cgtcggacataccaatg

SEQ ID NO: 7610 - DNA, 18 bp, Artificial Sequence
  Synthetic Polynucleotide
gatacccaacatcagtcg

SEQ ID NO: 7611 - DNA, 18 bp, Artificial Sequence
  Synthetic Polynucleotide
taccatcgggtctgattc

SEQ ID NO: 7612 - DNA, 19 bp, Artificial Sequence
  Synthetic Polynucleotide
tggaattttcatccaacga

SEQ ID NO: 7613 - DNA, 18 bp, Artificial Sequence
  Synthetic Polynucleotide
atgaaatgccccagtgcc

SEQ ID NO: 7614 - DNA, 20 bp, Artificial Sequence
  Synthetic Polynucleotide
atcattgaccactgagctat

SEQ ID NO: 7615 - DNA, 20 bp, Artificial Sequence
  Synthetic Polynucleotide
tgctaagattgtaaacacgg

SEQ ID NO: 7616 - DNA, 18 bp, Artificial Sequence
  Synthetic Polynucleotide
tctcatcctggactacat

SEQ ID NO: 7617 - DNA, 20 bp, Artificial Sequence
  Synthetic Polynucleotide
tctagcgttctcacattctt

SEQ ID NO: 7618 - DNA, 17 bp, Artificial Sequence
  Synthetic Polynucleotide
tattgcatctgtcctga

SEQ ID NO: 7619 - DNA, 19 bp, Artificial Sequence
  Synthetic Polynucleotide
cgctttgtcactcacttcg

SEQ ID NO: 7620 - DNA, 17 bp, Artificial Sequence
  Synthetic Polynucleotide
ttcacatgattccgcaa

SEQ ID NO: 7621 - DNA, 20 bp, Artificial Sequence
  Synthetic Polynucleotide
tttccgtcactatacaaaag

SEQ ID NO: 7622 - DNA, 18 bp, Artificial Sequence
  Synthetic Polynucleotide
tttattgctctcgacagg

SEQ ID NO: 7623 - DNA, 17 bp, Artificial Sequence
  Synthetic Polynucleotide
ctccggtttctgccagt

SEQ ID NO: 7624 - DNA, 17 bp, Artificial Sequence
  Synthetic Polynucleotide
tcgaactctccgcctcc

SEQ ID NO: 7625 - DNA, 20 bp, Artificial Sequence
  Synthetic Polynucleotide
ttctttgatcttttgcttca

SEQ ID NO: 7626 - DNA, 20 bp, Artificial Sequence
  Synthetic Polynucleotide
gagctgaaggattttgtcag

SEQ ID NO: 7627 - DNA, 19 bp, Artificial Sequence
  Synthetic Polynucleotide
tagtcgccatccacatatc

SEQ ID NO: 7628 - DNA, 19 bp, Artificial Sequence
  Synthetic Polynucleotide
ggctaactattcactacca

SEQ ID NO: 7629 - DNA, 19 bp, Artificial Sequence
  Synthetic Polynucleotide
gggtcctgtaactatcaga

SEQ ID NO: 7630 - DNA, 17 bp, Artificial Sequence
  Synthetic Polynucleotide
ccccagatagttcacta

SEQ ID NO: 7631 - DNA, 18 bp, Artificial Sequence
  Synthetic Polynucleotide
catcgttccacttaagca

SEQ ID NO: 7632 - DNA, 18 bp, Artificial Sequence
  Synthetic Polynucleotide
tcgaacaattaccccaca

SEQ ID NO: 7633 - DNA, 19 bp, Artificial Sequence
  Synthetic Polynucleotide
tcggtctgttcttaatgaa

SEQ ID NO: 7634 - DNA, 18 bp, Artificial Sequence
  Synthetic Polynucleotide
cagccgttcctcttatgc

SEQ ID NO: 7635 - DNA, 17 bp, Artificial Sequence
  Synthetic Polynucleotide
tatctgcatgattcgca

SEQ ID NO: 7636 - DNA, 17 bp, Artificial Sequence
  Synthetic Polynucleotide
actgccactgctgaagg

SEQ ID NO: 7637 - DNA, 17 bp, Artificial Sequence
  Synthetic Polynucleotide
cacctacaccacagtcc

SEQ ID NO: 7638 - DNA, 19 bp, Artificial Sequence
  Synthetic Polynucleotide
gcacaccaattatcaccat

SEQ ID NO: 7639 - DNA, 20 bp, Artificial Sequence
  Synthetic Polynucleotide
tagtattcatacgttcacaa

SEQ ID NO: 7640 - DNA, 18 bp, Artificial Sequence
  Synthetic Polynucleotide
gaacctgcttgactagat

SEQ ID NO: 7641 - DNA, 20 bp, Artificial Sequence
  Synthetic Polynucleotide
agattcctacctcctcccaa

SEQ ID NO: 7642 - DNA, 20 bp, Artificial Sequence
  Synthetic Polynucleotide
tattgtgagatgatgggtat

SEQ ID NO: 7643 - DNA, 17 bp, Artificial Sequence
  Synthetic Polynucleotide
gctttataccgcagaac

SEQ ID NO: 7644 - DNA, 18 bp, Artificial Sequence
  Synthetic Polynucleotide
cgggatattattggcact

SEQ ID NO: 7645 - DNA, 19 bp, Artificial Sequence
  Synthetic Polynucleotide
atgaagcatattcagttga

SEQ ID NO: 7646 - DNA, 19 bp, Artificial Sequence
  Synthetic Polynucleotide
gagatgatggatcgccagt

SEQ ID NO: 7647 - DNA, 17 bp, Artificial Sequence
  Synthetic Polynucleotide
accaggccgtacttgtc

SEQ ID NO: 7648 - DNA, 18 bp, Artificial Sequence
  Synthetic Polynucleotide
gagttcgacgccgttagt

SEQ ID NO: 7649 - DNA, 17 bp, Artificial Sequence
  Synthetic Polynucleotide
tctgagatgagaatcga

SEQ ID NO: 7650 - DNA, 17 bp, Artificial Sequence
  Synthetic Polynucleotide
atgtcagctatgtgtga

SEQ ID NO: 7651 - DNA, 17 bp, Artificial Sequence
  Synthetic Polynucleotide
gttagcttggtcctcat

SEQ ID NO: 7652 - DNA, 19 bp, Artificial Sequence
  Synthetic Polynucleotide
gaagtcttcaacatggatg

SEQ ID NO: 7653 - DNA, 19 bp, Artificial Sequence
  Synthetic Polynucleotide
ctgcatttgtatccaggcc

SEQ ID NO: 7654 - DNA, 20 bp, Artificial Sequence
  Synthetic Polynucleotide
acagacgttccactatgccg

SEQ ID NO: 7655 - DNA, 19 bp, Artificial Sequence
  Synthetic Polynucleotide
ccacgcttaaccactcctg

SEQ ID NO: 7656 - DNA, 17 bp, Artificial Sequence
  Synthetic Polynucleotide
accaaagccgagatggc

SEQ ID NO: 7657 - DNA, 17 bp, Artificial Sequence
  Synthetic Polynucleotide
gtagcagcatgagtacc

SEQ ID NO: 7658 - DNA, 17 bp, Artificial Sequence
  Synthetic Polynucleotide
ttccaggaaaacgacaa

SEQ ID NO: 7659 - DNA, 17 bp, Artificial Sequence
  Synthetic Polynucleotide
ctctagcacccgttggg

SEQ ID NO: 7660 - DNA, 19 bp, Artificial Sequence
  Synthetic Polynucleotide
tgtgggatttcttcattct

SEQ ID NO: 7661 - DNA, 17 bp, Artificial Sequence
  Synthetic Polynucleotide
tcccagaaaagtttcca

SEQ ID NO: 7662 - DNA, 17 bp, Artificial Sequence
  Synthetic Polynucleotide
gacattttgtgtcacga

SEQ ID NO: 7663 - DNA, 17 bp, Artificial Sequence
  Synthetic Polynucleotide
cgcccctatggtttccc

SEQ ID NO: 7664 - DNA, 18 bp, Artificial Sequence
  Synthetic Polynucleotide
acataactgtcctgtgtg

SEQ ID NO: 7665 - DNA, 18 bp, Artificial Sequence
  Synthetic Polynucleotide
tactccttagtctcaacc

SEQ ID NO: 7666 - DNA, 19 bp, Artificial Sequence
  Synthetic Polynucleotide
tgttgttcaggaaaacgac

SEQ ID NO: 7667 - DNA, 18 bp, Artificial Sequence
  Synthetic Polynucleotide
tagtatcagcagcatgta

SEQ ID NO: 7668 - DNA, 20 bp, Artificial Sequence
  Synthetic Polynucleotide
tagctatgataacctcaaca

SEQ ID NO: 7669 - DNA, 18 bp, Artificial Sequence
  Synthetic Polynucleotide
ccagtcttgagattgcaa

SEQ ID NO: 7670 - DNA, 18 bp, Artificial Sequence
  Synthetic Polynucleotide
tctactagcctccttagg

SEQ ID NO: 7671 - DNA, 17 bp, Artificial Sequence
  Synthetic Polynucleotide
gtgtatggcgtggtgca

SEQ ID NO: 7672 - DNA, 18 bp, Artificial Sequence
  Synthetic Polynucleotide
tggaccaatgtgatcatg

SEQ ID NO: 7673 - DNA, 19 bp, Artificial Sequence
  Synthetic Polynucleotide
acaactcaacaccttgtcc

SEQ ID NO: 7674 - DNA, 18 bp, Artificial Sequence
  Synthetic Polynucleotide
cgtaccaaagagaaaacc

SEQ ID NO: 7675 - DNA, 19 bp, Artificial Sequence
  Synthetic Polynucleotide
cgattcaatatcaacggtt

SEQ ID NO: 7676 - DNA, 19 bp, Artificial Sequence
  Synthetic Polynucleotide
taagcatatgggattgaaa

SEQ ID NO: 7677 - DNA, 20 bp, Artificial Sequence
  Synthetic Polynucleotide
agatatgtaaattcccgtcg

SEQ ID NO: 7678 - DNA, 18 bp, Artificial Sequence
  Synthetic Polynucleotide
ggatagatactgcgaaca

SEQ ID NO: 7679 - DNA, 17 bp, Artificial Sequence
  Synthetic Polynucleotide
tctagtacgttaggccc

SEQ ID NO: 7680 - DNA, 18 bp, Artificial Sequence
  Synthetic Polynucleotide
aaccttacgtatatcgcg

SEQ ID NO: 7681 - DNA, 20 bp, Artificial Sequence
  Synthetic Polynucleotide
cgttagtctcgattgcctgc

SEQ ID NO: 7682 - DNA, 20 bp, Artificial Sequence
  Synthetic Polynucleotide
actcatgttctaattccccg

SEQ ID NO: 7683 - DNA, 18 bp, Artificial Sequence
  Synthetic Polynucleotide
tattccatccacatctgt

SEQ ID NO: 7684 - DNA, 20 bp, Artificial Sequence
  Synthetic Polynucleotide
ttcagaactgtaaagatcga

SEQ ID NO: 7685 - DNA, 18 bp, Artificial Sequence
  Synthetic Polynucleotide
aagaatggacgaaatgac

SEQ ID NO: 7686 - DNA, 18 bp, Artificial Sequence
  Synthetic Polynucleotide
gctaaaacctcaaacagc

SEQ ID NO: 7687 - DNA, 17 bp, Artificial Sequence
  Synthetic Polynucleotide
ccgaagaccctaagcac

SEQ ID NO: 7688 - DNA, 18 bp, Artificial Sequence
  Synthetic Polynucleotide
ggaccctcttatttagca

SEQ ID NO: 7689 - DNA, 19 bp, Artificial Sequence
  Synthetic Polynucleotide
actcaattctcgttcctgg

SEQ ID NO: 7690 - DNA, 18 bp, Artificial Sequence
  Synthetic Polynucleotide
tacaagaaccatcaacta

SEQ ID NO: 7691 - DNA, 19 bp, Artificial Sequence
  Synthetic Polynucleotide
ctgcatacaattcaggatc

SEQ ID NO: 7692 - DNA, 17 bp, Artificial Sequence
  Synthetic Polynucleotide
atcttgactgcatgaca

SEQ ID NO: 7693 - DNA, 20 bp, Artificial Sequence
  Synthetic Polynucleotide
tcttgaccatccttaactgc

SEQ ID NO: 7694 - DNA, 19 bp, Artificial Sequence
  Synthetic Polynucleotide
aaaacagagtagctcttga

SEQ ID NO: 7695 - DNA, 19 bp, Artificial Sequence
  Synthetic Polynucleotide
gtatgttatttgaagggca

SEQ ID NO: 7696 - DNA, 19 bp, Artificial Sequence
  Synthetic Polynucleotide
aacaaactgactctcgaag

SEQ ID NO: 7697 - DNA, 18 bp, Artificial Sequence
  Synthetic Polynucleotide
ccgaaatagctcaatgta

SEQ ID NO: 7698 - DNA, 18 bp, Artificial Sequence
  Synthetic Polynucleotide
atatgatatggcggctac

SEQ ID NO: 7699 - DNA, 19 bp, Artificial Sequence
  Synthetic Polynucleotide
atctttcaacgattcctca

SEQ ID NO: 7700 - DNA, 20 bp, Artificial Sequence
  Synthetic Polynucleotide
ggatgaagctccagtgtatt

SEQ ID NO: 7701 - DNA, 18 bp, Artificial Sequence
  Synthetic Polynucleotide
acctgatccagtgagatg

SEQ ID NO: 7702 - DNA, 19 bp, Artificial Sequence
  Synthetic Polynucleotide
tgaggcacttcaacatatg

SEQ ID NO: 7703 - DNA, 18 bp, Artificial Sequence
  Synthetic Polynucleotide
ggtaccccttgagatcct

SEQ ID NO: 7704 - DNA, 19 bp, Artificial Sequence
  Synthetic Polynucleotide
acatgaaaagtcagcacaa

SEQ ID NO: 7705 - DNA, 19 bp, Artificial Sequence
  Synthetic Polynucleotide
ccttggtagacatatcctc

SEQ ID NO: 7706 - DNA, 20 bp, Artificial Sequence
  Synthetic Polynucleotide
acagtcaagagaatcattga

SEQ ID NO: 7707 - DNA, 18 bp, Artificial Sequence
  Synthetic Polynucleotide
aacacagtacacttctga

SEQ ID NO: 7708 - DNA, 19 bp, Artificial Sequence
  Synthetic Polynucleotide
gagacagtcctcctttcca

SEQ ID NO: 7709 - DNA, 17 bp, Artificial Sequence
  Synthetic Polynucleotide
gcatcctgctcatcatg

SEQ ID NO: 7710 - DNA, 17 bp, Artificial Sequence
  Synthetic Polynucleotide
atgtggacaagatggcc

SEQ ID NO: 7711 - DNA, 19 bp, Artificial Sequence
  Synthetic Polynucleotide
ggttcagatcatcctgcat

SEQ ID NO: 7712 - DNA, 17 bp, Artificial Sequence
  Synthetic Polynucleotide
aaactaacacccctcct

SEQ ID NO: 7713 - DNA, 18 bp, Artificial Sequence
  Synthetic Polynucleotide
gggtcatcataaacctcc

SEQ ID NO: 7714 - DNA, 19 bp, Artificial Sequence
  Synthetic Polynucleotide
ctgatgctcattacaagtc

SEQ ID NO: 7715 - DNA, 19 bp, Artificial Sequence
  Synthetic Polynucleotide
aaattaccccagaaatcag

SEQ ID NO: 7716 - DNA, 20 bp, Artificial Sequence
  Synthetic Polynucleotide
agttgagagagatatcatgg

SEQ ID NO: 7717 - DNA, 18 bp, Artificial Sequence
  Synthetic Polynucleotide
ggagaattatcgtggacc

SEQ ID NO: 7718 - DNA, 17 bp, Artificial Sequence
  Synthetic Polynucleotide
acctggtacggagagtg

SEQ ID NO: 7719 - DNA, 20 bp, Artificial Sequence
  Synthetic Polynucleotide
caagtcctttgcttatgtta

SEQ ID NO: 7720 - DNA, 17 bp, Artificial Sequence
  Synthetic Polynucleotide
atcgagccaaagacgga

SEQ ID NO: 7721 - DNA, 20 bp, Artificial Sequence
  Synthetic Polynucleotide
cattgtaccctgaatcgtga

SEQ ID NO: 7722 - DNA, 18 bp, Artificial Sequence
  Synthetic Polynucleotide
ggccctaattcccaagtc

SEQ ID NO: 7723 - DNA, 17 bp, Artificial Sequence
  Synthetic Polynucleotide
caacacttccctcagcc

SEQ ID NO: 7724 - DNA, 18 bp, Artificial Sequence
  Synthetic Polynucleotide
gaacttcacacccgagcc

SEQ ID NO: 7725 - DNA, 17 bp, Artificial Sequence
  Synthetic Polynucleotide
ccaaatcctccctgttt

SEQ ID NO: 7726 - DNA, 19 bp, Artificial Sequence
  Synthetic Polynucleotide
tcacactagacaacattac

SEQ ID NO: 7727 - DNA, 19 bp, Artificial Sequence
  Synthetic Polynucleotide
ccccatatctatgaacaga

SEQ ID NO: 7728 - DNA, 20 bp, Artificial Sequence
  Synthetic Polynucleotide
gagtctttacattttcaagc

SEQ ID NO: 7729 - DNA, 18 bp, Artificial Sequence
  Synthetic Polynucleotide
gtagtatacccatgcgtg

SEQ ID NO: 7730 - DNA, 17 bp, Artificial Sequence
  Synthetic Polynucleotide
caaaccgcattcacccc

SEQ ID NO: 7731 - DNA, 20 bp, Artificial Sequence
  Synthetic Polynucleotide
caagagtttactgtccgatg

SEQ ID NO: 7732 - DNA, 19 bp, Artificial Sequence
  Synthetic Polynucleotide
tcaacagaatcctttgctt

SEQ ID NO: 7733 - DNA, 17 bp, Artificial Sequence
  Synthetic Polynucleotide
ttgccagaggggataat

SEQ ID NO: 7734 - DNA, 17 bp, Artificial Sequence
  Synthetic Polynucleotide
tctcagggaccaaccct

SEQ ID NO: 7735 - DNA, 19 bp, Artificial Sequence
  Synthetic Polynucleotide
ctcaagatcatgtcgaagt

SEQ ID NO: 7736 - DNA, 17 bp, Artificial Sequence
  Synthetic Polynucleotide
cagcgataagccctagc

SEQ ID NO: 7737 - DNA, 17 bp, Artificial Sequence
  Synthetic Polynucleotide
ggaacaggcccatatac

SEQ ID NO: 7738 - DNA, 17 bp, Artificial Sequence
  Synthetic Polynucleotide
ttaatggtgtcaagggg

SEQ ID NO: 7739 - DNA, 17 bp, Artificial Sequence
  Synthetic Polynucleotide
aggctgatagatgtgca

SEQ ID NO: 7740 - DNA, 20 bp, Artificial Sequence
  Synthetic Polynucleotide
catttgtgtcatgtgttgac

SEQ ID NO: 7741 - DNA, 20 bp, Artificial Sequence
  Synthetic Polynucleotide
atcagtatctgctacttcaa

SEQ ID NO: 7742 - DNA, 19 bp, Artificial Sequence
  Synthetic Polynucleotide
ttgtagctcaagaacatgt

SEQ ID NO: 7743 - DNA, 18 bp, Artificial Sequence
  Synthetic Polynucleotide
aatgccaagacctgtacc

SEQ ID NO: 7744 - DNA, 18 bp, Artificial Sequence
  Synthetic Polynucleotide
aaatgaaagaagacgcta

SEQ ID NO: 7745 - DNA, 20 bp, Artificial Sequence
  Synthetic Polynucleotide
acttgagatacacagtaggt

SEQ ID NO: 7746 - DNA, 20 bp, Artificial Sequence
  Synthetic Polynucleotide
tgtgatcgttatcctatacg

SEQ ID NO: 7747 - DNA, 17 bp, Artificial Sequence
  Synthetic Polynucleotide
ggcgttccaatatgcat

SEQ ID NO: 7748 - DNA, 17 bp, Artificial Sequence
  Synthetic Polynucleotide
gatgcagaggtggttgc

SEQ ID NO: 7749 - DNA, 17 bp, Artificial Sequence
  Synthetic Polynucleotide
aagttgccagtaaagcc

SEQ ID NO: 7750 - DNA, 18 bp, Artificial Sequence
  Synthetic Polynucleotide
tacaggatgatagttggg

SEQ ID NO: 7751 - DNA, 17 bp, Artificial Sequence
  Synthetic Polynucleotide
cttccccaaaacctcct

SEQ ID NO: 7752 - DNA, 20 bp, Artificial Sequence
  Synthetic Polynucleotide
tttgatgaaatacttgaggg

SEQ ID NO: 7753 - DNA, 19 bp, Artificial Sequence
  Synthetic Polynucleotide
tccaacgagtgaatacacg

SEQ ID NO: 7754 - DNA, 17 bp, Artificial Sequence
  Synthetic Polynucleotide
ctcgagtgaagcgttat

SEQ ID NO: 7755 - DNA, 20 bp, Artificial Sequence
  Synthetic Polynucleotide
caaataccccttgcattatt

SEQ ID NO: 7756 - DNA, 17 bp, Artificial Sequence
  Synthetic Polynucleotide
cagttaagcgtggcatt

SEQ ID NO: 7757 - DNA, 20 bp, Artificial Sequence
  Synthetic Polynucleotide
gtgaatctgtgcttggttga

SEQ ID NO: 7758 - DNA, 20 bp, Artificial Sequence
  Synthetic Polynucleotide
taagcacacctttaataaac

SEQ ID NO: 7759 - DNA, 20 bp, Artificial Sequence
  Synthetic Polynucleotide
ggtaggcatatctgtaatct

SEQ ID NO: 7760 - DNA, 18 bp, Artificial Sequence
  Synthetic Polynucleotide
tggaaggaaaagctctta

SEQ ID NO: 7761 - DNA, 18 bp, Artificial Sequence
  Synthetic Polynucleotide
ataagcccaactgcgttt

SEQ ID NO: 7762 - DNA, 20 bp, Artificial Sequence
  Synthetic Polynucleotide
agttcatggaaatggaacta

SEQ ID NO: 7763 - DNA, 17 bp, Artificial Sequence
  Synthetic Polynucleotide
acctggttgaggaactt

SEQ ID NO: 7764 - DNA, 17 bp, Artificial Sequence
  Synthetic Polynucleotide
tcatcgaaggcaacatg

SEQ ID NO: 7765 - DNA, 17 bp, Artificial Sequence
  Synthetic Polynucleotide
cgacggatacaaatcct

SEQ ID NO: 7766 - DNA, 17 bp, Artificial Sequence
  Synthetic Polynucleotide
ggtacgggatagagtcg

SEQ ID NO: 7767 - DNA, 18 bp, Artificial Sequence
  Synthetic Polynucleotide
tcttctttactctctgcc

SEQ ID NO: 7768 - DNA, 20 bp, Artificial Sequence
  Synthetic Polynucleotide
tgctattcaacattcagtta

SEQ ID NO: 7769 - DNA, 18 bp, Artificial Sequence
  Synthetic Polynucleotide
atatgatgtcccagcgtg

SEQ ID NO: 7770 - DNA, 19 bp, Artificial Sequence
  Synthetic Polynucleotide
ttgtgaaactagtaaaccg

SEQ ID NO: 7771 - DNA, 17 bp, Artificial Sequence
  Synthetic Polynucleotide
aggacctgatcgaagac

SEQ ID NO: 7772 - DNA, 17 bp, Artificial Sequence
  Synthetic Polynucleotide
ctggcgatcttagacag

SEQ ID NO: 7773 - DNA, 17 bp, Artificial Sequence
  Synthetic Polynucleotide
aactgacccattctcag

SEQ ID NO: 7774 - DNA, 17 bp, Artificial Sequence
  Synthetic Polynucleotide
ccccagctcggaaaacg

SEQ ID NO: 7775 - DNA, 17 bp, Artificial Sequence
  Synthetic Polynucleotide
catggtcatgatacggg

SEQ ID NO: 7776 - DNA, 18 bp, Artificial Sequence
  Synthetic Polynucleotide
atgacagttcaaaagtgc

SEQ ID NO: 7777 - DNA, 17 bp, Artificial Sequence
  Synthetic Polynucleotide
gtagaacatcgtggtcg

SEQ ID NO: 7778 - DNA, 17 bp, Artificial Sequence
  Synthetic Polynucleotide
gctgctcaatctgtccg

SEQ ID NO: 7779 - DNA, 17 bp, Artificial Sequence
  Synthetic Polynucleotide
aacggtatgtcttgcag

SEQ ID NO: 7780 - DNA, 19 bp, Artificial Sequence
  Synthetic Polynucleotide
tggcggtaatccaactacc

SEQ ID NO: 7781 - DNA, 18 bp, Artificial Sequence
  Synthetic Polynucleotide
ttttggcaaccaatcctt

SEQ ID NO: 7782 - DNA, 20 bp, Artificial Sequence
  Synthetic Polynucleotide
aagatttaccacaagcagtg

SEQ ID NO: 7783 - DNA, 19 bp, Artificial Sequence
  Synthetic Polynucleotide
cgcatattacacagttacg

SEQ ID NO: 7784 - DNA, 17 bp, Artificial Sequence
  Synthetic Polynucleotide
gcaggacaaacacaagt

SEQ ID NO: 7785 - DNA, 17 bp, Artificial Sequence
  Synthetic Polynucleotide
gggtagttggattaccg

SEQ ID NO: 7786 - DNA, 17 bp, Artificial Sequence
  Synthetic Polynucleotide
gtactcacagaagccct

SEQ ID NO: 7787 - DNA, 20 bp, Artificial Sequence
  Synthetic Polynucleotide
atccgcacaagaagatgact

SEQ ID NO: 7788 - DNA, 19 bp, Artificial Sequence
  Synthetic Polynucleotide
ggatgacttcaaagaccca

SEQ ID NO: 7789 - DNA, 20 bp, Artificial Sequence
  Synthetic Polynucleotide
aagttgagcaaagttagcag

SEQ ID NO: 7790 - DNA, 19 bp, Artificial Sequence
  Synthetic Polynucleotide
ccgtccgaaaagaaaagat

SEQ ID NO: 7791 - DNA, 19 bp, Artificial Sequence
  Synthetic Polynucleotide
aagggagtagtagtattcg

SEQ ID NO: 7792 - DNA, 20 bp, Artificial Sequence
  Synthetic Polynucleotide
tcaatcaaacagataagcca

SEQ ID NO: 7793 - DNA, 19 bp, Artificial Sequence
  Synthetic Polynucleotide
cacgtcctccacataagcg

SEQ ID NO: 7794 - DNA, 18 bp, Artificial Sequence
  Synthetic Polynucleotide
gcacgcttacgacaacgt

SEQ ID NO: 7795 - DNA, 18 bp, Artificial Sequence
  Synthetic Polynucleotide
catctcgaccacgtagag

SEQ ID NO: 7796 - DNA, 20 bp, Artificial Sequence
  Synthetic Polynucleotide
cattagtttccgcaataagt

SEQ ID NO: 7797 - DNA, 17 bp, Artificial Sequence
  Synthetic Polynucleotide
aaaaccaccatcgaagt

SEQ ID NO: 7798 - DNA, 18 bp, Artificial Sequence
  Synthetic Polynucleotide
tgcctggataattactga

SEQ ID NO: 7799 - DNA, 17 bp, Artificial Sequence
  Synthetic Polynucleotide
acgaagccgaccgtctg

SEQ ID NO: 7800 - DNA, 18 bp, Artificial Sequence
  Synthetic Polynucleotide
ccttggaactcgtagatc

SEQ ID NO: 7801 - DNA, 17 bp, Artificial Sequence
  Synthetic Polynucleotide
tgatttctccgccctct

SEQ ID NO: 7802 - DNA, 19 bp, Artificial Sequence
  Synthetic Polynucleotide
gctatcacacagagctgac

SEQ ID NO: 7803 - DNA, 17 bp, Artificial Sequence
  Synthetic Polynucleotide
ccaagctgaccatgaac

SEQ ID NO: 7804 - DNA, 19 bp, Artificial Sequence
  Synthetic Polynucleotide
cctgccgcaatgatgatga

SEQ ID NO: 7805 - DNA, 17 bp, Artificial Sequence
  Synthetic Polynucleotide
gacgtacaccaccgctg

SEQ ID NO: 7806 - DNA, 18 bp, Artificial Sequence
  Synthetic Polynucleotide
cgcataccagtagtcact

SEQ ID NO: 7807 - DNA, 17 bp, Artificial Sequence
  Synthetic Polynucleotide
ccctccaataactcagg

SEQ ID NO: 7808 - DNA, 17 bp, Artificial Sequence
  Synthetic Polynucleotide
attcgcaaacaaagggt

SEQ ID NO: 7809 - DNA, 17 bp, Artificial Sequence
  Synthetic Polynucleotide
tcatttaatcgcctcca

SEQ ID NO: 7810 - DNA, 18 bp, Artificial Sequence
  Synthetic Polynucleotide
ggtctgaatacgaaaacg

SEQ ID NO: 7811 - DNA, 18 bp, Artificial Sequence
  Synthetic Polynucleotide
cttcaccctccacttcct

SEQ ID NO: 7812 - DNA, 18 bp, Artificial Sequence
  Synthetic Polynucleotide
aaggaggaacaagcatga

SEQ ID NO: 7813 - DNA, 18 bp, Artificial Sequence
  Synthetic Polynucleotide
agttgtgacttcgctagc

SEQ ID NO: 7814 - DNA, 17 bp, Artificial Sequence
  Synthetic Polynucleotide
acagcatggtcttacag

SEQ ID NO: 7815 - DNA, 17 bp, Artificial Sequence
  Synthetic Polynucleotide
acctcgccgaacagatc

SEQ ID NO: 7816 - DNA, 17 bp, Artificial Sequence
  Synthetic Polynucleotide
cgtcaacaatcacatcg

SEQ ID NO: 7817 - DNA, 18 bp, Artificial Sequence
  Synthetic Polynucleotide
tcggattcaaaacagccg

SEQ ID NO: 7818 - DNA, 17 bp, Artificial Sequence
  Synthetic Polynucleotide
cgacctcgatctcgccc

SEQ ID NO: 7819 - DNA, 20 bp, Artificial Sequence
  Synthetic Polynucleotide
cgtcggaaacgtattctttt

SEQ ID NO: 7820 - DNA, 17 bp, Artificial Sequence
  Synthetic Polynucleotide
tagaactggtgcttcag

SEQ ID NO: 7821 - DNA, 20 bp, Artificial Sequence
  Synthetic Polynucleotide
gtatgcaatcttttactggg

SEQ ID NO: 7822 - DNA, 17 bp, Artificial Sequence
  Synthetic Polynucleotide
tacaatccccgaactta

SEQ ID NO: 7823 - DNA, 20 bp, Artificial Sequence
  Synthetic Polynucleotide
ggaactggtttagattcttg

SEQ ID NO: 7824 - DNA, 19 bp, Artificial Sequence
  Synthetic Polynucleotide
gaacactcagctacttttg

SEQ ID NO: 7825 - DNA, 18 bp, Artificial Sequence
  Synthetic Polynucleotide
tatcgaaagttatccagc

SEQ ID NO: 7826 - DNA, 17 bp, Artificial Sequence
  Synthetic Polynucleotide
cctgaacttatcgccgc

SEQ ID NO: 7827 - DNA, 17 bp, Artificial Sequence
  Synthetic Polynucleotide
ggtgtccaaggcatccc

SEQ ID NO: 7828 - DNA, 19 bp, Artificial Sequence
  Synthetic Polynucleotide
aatcgaacgccgtactgtg

SEQ ID NO: 7829 - DNA, 17 bp, Artificial Sequence
  Synthetic Polynucleotide
gtcatcctcgtcgtctc

SEQ ID NO: 7830 - DNA, 17 bp, Artificial Sequence
  Synthetic Polynucleotide
tggccctgtgaccttcg

SEQ ID NO: 7831 - DNA, 17 bp, Artificial Sequence
  Synthetic Polynucleotide
cgcaagccctttaccgt

SEQ ID NO: 7832 - DNA, 17 bp, Artificial Sequence
  Synthetic Polynucleotide
ggcccttctttctttga

SEQ ID NO: 7833 - DNA, 18 bp, Artificial Sequence
  Synthetic Polynucleotide
ccacatcaatcactcacc

SEQ ID NO: 7834 - DNA, 19 bp, Artificial Sequence
  Synthetic Polynucleotide
tcattcgcttttagtgaga

SEQ ID NO: 7835 - DNA, 18 bp, Artificial Sequence
  Synthetic Polynucleotide
ccgctatcaaggattacg

SEQ ID NO: 7836 - DNA, 19 bp, Artificial Sequence
  Synthetic Polynucleotide
ttatcaacgccaatccttg

SEQ ID NO: 7837 - DNA, 19 bp, Artificial Sequence
  Synthetic Polynucleotide
tttgccaacgtcatataag

SEQ ID NO: 7838 - DNA, 17 bp, Artificial Sequence
  Synthetic Polynucleotide
gcaaccctgaatgacat

SEQ ID NO: 7839 - DNA, 18 bp, Artificial Sequence
  Synthetic Polynucleotide
agtctgctttgatttggt

SEQ ID NO: 7840 - DNA, 19 bp, Artificial Sequence
  Synthetic Polynucleotide
tagttactatttgccacaa

SEQ ID NO: 7841 - DNA, 20 bp, Artificial Sequence
  Synthetic Polynucleotide
cgattttagaagggttttct

SEQ ID NO: 7842 - DNA, 17 bp, Artificial Sequence
  Synthetic Polynucleotide
cgcaatggctcttaaaa

SEQ ID NO: 7843 - DNA, 19 bp, Artificial Sequence
  Synthetic Polynucleotide
agtgctttccaatttgtct

SEQ ID NO: 7844 - DNA, 18 bp, Artificial Sequence
  Synthetic Polynucleotide
ctggtgtgctgtctattg

SEQ ID NO: 7845 - DNA, 19 bp, Artificial Sequence
  Synthetic Polynucleotide
gtggctttctgtttctact

SEQ ID NO: 7846 - DNA, 19 bp, Artificial Sequence
  Synthetic Polynucleotide
actttactagcccgattcg

SEQ ID NO: 7847 - DNA, 20 bp, Artificial Sequence
  Synthetic Polynucleotide
gtagtaggacttgtcggtcg

SEQ ID NO: 7848 - DNA, 18 bp, Artificial Sequence
  Synthetic Polynucleotide
caactctaccatcgactc

SEQ ID NO: 7849 - DNA, 18 bp, Artificial Sequence
  Synthetic Polynucleotide
gtcttcttgtcgttgccg

SEQ ID NO: 7850 - DNA, 18 bp, Artificial Sequence
  Synthetic Polynucleotide
cctcatgccgattcaccc

SEQ ID NO: 7851 - DNA, 17 bp, Artificial Sequence
  Synthetic Polynucleotide
gctcctggctcacagaa

SEQ ID NO: 7852 - DNA, 18 bp, Artificial Sequence
  Synthetic Polynucleotide
ctcatcgttgacacgagc

SEQ ID NO: 7853 - DNA, 17 bp, Artificial Sequence
  Synthetic Polynucleotide
gaggcttatgaccagcc

SEQ ID NO: 7854 - DNA, 20 bp, Artificial Sequence
  Synthetic Polynucleotide
tttgaatagttttgacccat

SEQ ID NO: 7855 - DNA, 17 bp, Artificial Sequence
  Synthetic Polynucleotide
gccaccttggattacct

SEQ ID NO: 7856 - DNA, 19 bp, Artificial Sequence
  Synthetic Polynucleotide
cgtggctcaatcaggttca

SEQ ID NO: 7857 - DNA, 20 bp, Artificial Sequence
  Synthetic Polynucleotide
aaggtccattttgaatgtaa

SEQ ID NO: 7858 - DNA, 20 bp, Artificial Sequence
  Synthetic Polynucleotide
agctacaactcttatcagct

SEQ ID NO: 7859 - DNA, 20 bp, Artificial Sequence
  Synthetic Polynucleotide
atcaggtgcgtttgatagcg

SEQ ID NO: 7860 - DNA, 20 bp, Artificial Sequence
  Synthetic Polynucleotide
aggctctttaattcctagag

SEQ ID NO: 7861 - DNA, 18 bp, Artificial Sequence
  Synthetic Polynucleotide
gcccattcttttaccaaa

SEQ ID NO: 7862 - DNA, 19 bp, Artificial Sequence
  Synthetic Polynucleotide
aagactttggttacggttc

SEQ ID NO: 7863 - DNA, 20 bp, Artificial Sequence
  Synthetic Polynucleotide
tctgatgaattacgtctttc

SEQ ID NO: 7864 - DNA, 17 bp, Artificial Sequence
  Synthetic Polynucleotide
gatcacatggttacccg

SEQ ID NO: 7865 - DNA, 20 bp, Artificial Sequence
  Synthetic Polynucleotide
aagcgtttgttgttatcttt

SEQ ID NO: 7866 - DNA, 19 bp, Artificial Sequence
  Synthetic Polynucleotide
agtcagtctcatccgcttg

SEQ ID NO: 7867 - DNA, 19 bp, Artificial Sequence
  Synthetic Polynucleotide
catccttatccgtcaattc

SEQ ID NO: 7868 - DNA, 18 bp, Artificial Sequence
  Synthetic Polynucleotide
ggcaatcagataccaatc

SEQ ID NO: 7869 - DNA, 19 bp, Artificial Sequence
  Synthetic Polynucleotide
ttcgaattgtttcgcctat

SEQ ID NO: 7870 - DNA, 17 bp, Artificial Sequence
  Synthetic Polynucleotide
gcactggatcacgttca

SEQ ID NO: 7871 - DNA, 19 bp, Artificial Sequence
  Synthetic Polynucleotide
gaatggtagtcaatgcaaa

SEQ ID NO: 7872 - DNA, 18 bp, Artificial Sequence
  Synthetic Polynucleotide
aagcgagcgtttgggaca

SEQ ID NO: 7873 - DNA, 20 bp, Artificial Sequence
  Synthetic Polynucleotide
gcttcgagatcctcctggac

SEQ ID NO: 7874 - DNA, 18 bp, Artificial Sequence
  Synthetic Polynucleotide
ccctcggagtctgtgttc

SEQ ID NO: 7875 - DNA, 19 bp, Artificial Sequence
  Synthetic Polynucleotide
tcagcactttggagaacta

SEQ ID NO: 7876 - DNA, 17 bp, Artificial Sequence
  Synthetic Polynucleotide
attggcaccttgtacgc

SEQ ID NO: 7877 - DNA, 19 bp, Artificial Sequence
  Synthetic Polynucleotide
agtgaagccttctcaaaat

SEQ ID NO: 7878 - DNA, 17 bp, Artificial Sequence
  Synthetic Polynucleotide
atcctacccctgtggag

SEQ ID NO: 7879 - DNA, 17 bp, Artificial Sequence
  Synthetic Polynucleotide
ccaaaatgggcgacagg

SEQ ID NO: 7880 - DNA, 17 bp, Artificial Sequence
  Synthetic Polynucleotide
ccctgaacttgatggcc

SEQ ID NO: 7881 - DNA, 18 bp, Artificial Sequence
  Synthetic Polynucleotide
gagtttgtacctgttccg

SEQ ID NO: 7882 - DNA, 17 bp, Artificial Sequence
  Synthetic Polynucleotide
cggtaattgaaaaggcg

SEQ ID NO: 7883 - DNA, 20 bp, Artificial Sequence
  Synthetic Polynucleotide
ccataacacttccgtaaata

SEQ ID NO: 7884 - DNA, 19 bp, Artificial Sequence
  Synthetic Polynucleotide
ggaattggaatgctcattg

SEQ ID NO: 7885 - DNA, 17 bp, Artificial Sequence
  Synthetic Polynucleotide
cttgtgggcacctataa

SEQ ID NO: 7886 - DNA, 18 bp, Artificial Sequence
  Synthetic Polynucleotide
agacaccccgtatggctt

SEQ ID NO: 7887 - DNA, 20 bp, Artificial Sequence
  Synthetic Polynucleotide
gagactctcccagaacgaag

SEQ ID NO: 7888 - DNA, 20 bp, Artificial Sequence
  Synthetic Polynucleotide
aacatgctgctcaattttat

SEQ ID NO: 7889 - DNA, 18 bp, Artificial Sequence
  Synthetic Polynucleotide
tcatgaaagctagaggat

SEQ ID NO: 7890 - DNA, 19 bp, Artificial Sequence
  Synthetic Polynucleotide
tgctcggtcaccctgattc

SEQ ID NO: 7891 - DNA, 20 bp, Artificial Sequence
  Synthetic Polynucleotide
actttctgctgcgtcttcat

SEQ ID NO: 7892 - DNA, 17 bp, Artificial Sequence
  Synthetic Polynucleotide
agtcaaggctgcgaaag

SEQ ID NO: 7893 - DNA, 19 bp, Artificial Sequence
  Synthetic Polynucleotide
cgagacaaaactgtcgtgt

SEQ ID NO: 7894 - DNA, 17 bp, Artificial Sequence
  Synthetic Polynucleotide
cctggctcaacaacctc

SEQ ID NO: 7895 - DNA, 20 bp, Artificial Sequence
  Synthetic Polynucleotide
agctaactacgtccttcttg

SEQ ID NO: 7896 - DNA, 17 bp, Artificial Sequence
  Synthetic Polynucleotide
tgacaatttcaccgctg

SEQ ID NO: 7897 - DNA, 17 bp, Artificial Sequence
  Synthetic Polynucleotide
cgctggttgagcccaac

SEQ ID NO: 7898 - DNA, 17 bp, Artificial Sequence
  Synthetic Polynucleotide
ggggagagggtctcttt

SEQ ID NO: 7899 - DNA, 18 bp, Artificial Sequence
  Synthetic Polynucleotide
gtcttgcagtaggacagc

SEQ ID NO: 7900 - DNA, 17 bp, Artificial Sequence
  Synthetic Polynucleotide
aggacggcacgcaaact

SEQ ID NO: 7901 - DNA, 17 bp, Artificial Sequence
  Synthetic Polynucleotide
ttatgcaccacgcttcc

SEQ ID NO: 7902 - DNA, 17 bp, Artificial Sequence
  Synthetic Polynucleotide
ctggggaaggtagacgc

SEQ ID NO: 7903 - DNA, 19 bp, Artificial Sequence
  Synthetic Polynucleotide
tttcttggcagttttcttt

SEQ ID NO: 7904 - DNA, 17 bp, Artificial Sequence
  Synthetic Polynucleotide
acagaacacgagtacgt

SEQ ID NO: 7905 - DNA, 17 bp, Artificial Sequence
  Synthetic Polynucleotide
attcgctggttgagccc

SEQ ID NO: 7906 - DNA, 17 bp, Artificial Sequence
  Synthetic Polynucleotide
gagcattttcgcatctg

SEQ ID NO: 7907 - DNA, 19 bp, Artificial Sequence
  Synthetic Polynucleotide
ccctttcgttgtacaccat

SEQ ID NO: 7908 - DNA, 18 bp, Artificial Sequence
  Synthetic Polynucleotide
caccaacatcgctgtacc

SEQ ID NO: 7909 - DNA, 17 bp, Artificial Sequence
  Synthetic Polynucleotide
ccgtcgcaactaactat

SEQ ID NO: 7910 - DNA, 17 bp, Artificial Sequence
  Synthetic Polynucleotide
tggagaaagttcacgtt

SEQ ID NO: 7911 - DNA, 17 bp, Artificial Sequence
  Synthetic Polynucleotide
catctccgtagagttcg

SEQ ID NO: 7912 - DNA, 20 bp, Artificial Sequence
  Synthetic Polynucleotide
cccctgaatagtaacaaaat

SEQ ID NO: 7913 - DNA, 17 bp, Artificial Sequence
  Synthetic Polynucleotide
gggagagggtatccttt

SEQ ID NO: 7914 - DNA, 18 bp, Artificial Sequence
  Synthetic Polynucleotide
aaaacagtatgcacctcc

SEQ ID NO: 7915 - DNA, 18 bp, Artificial Sequence
  Synthetic Polynucleotide
taccaccatgaacagagg

SEQ ID NO: 7916 - DNA, 19 bp, Artificial Sequence
  Synthetic Polynucleotide
tcagaggcaggttaaggta

SEQ ID NO: 7917 - DNA, 19 bp, Artificial Sequence
  Synthetic Polynucleotide
gagttgtaaagtaaaggcc

SEQ ID NO: 7918 - DNA, 18 bp, Artificial Sequence
  Synthetic Polynucleotide
ggaagtatgtagggacac

SEQ ID NO: 7919 - DNA, 17 bp, Artificial Sequence
  Synthetic Polynucleotide
aaacggcaggttcacgg

SEQ ID NO: 7920 - DNA, 20 bp, Artificial Sequence
  Synthetic Polynucleotide
tcatcatagcaccaaattta

SEQ ID NO: 7921 - DNA, 19 bp, Artificial Sequence
  Synthetic Polynucleotide
ccatccacgcaggtatctt

SEQ ID NO: 7922 - DNA, 17 bp, Artificial Sequence
  Synthetic Polynucleotide
taaagtctccgcattta

SEQ ID NO: 7923 - DNA, 17 bp, Artificial Sequence
  Synthetic Polynucleotide
ccgcacatttgtcggga

SEQ ID NO: 7924 - DNA, 19 bp, Artificial Sequence
  Synthetic Polynucleotide
catcagtattgtcgaatgc

SEQ ID NO: 7925 - DNA, 18 bp, Artificial Sequence
  Synthetic Polynucleotide
ccacacacgagtataggc

SEQ ID NO: 7926 - DNA, 17 bp, Artificial Sequence
  Synthetic Polynucleotide
ccatgttccacactttg

SEQ ID NO: 7927 - DNA, 17 bp, Artificial Sequence
  Synthetic Polynucleotide
cacatcatccacgcagt

SEQ ID NO: 7928 - DNA, 17 bp, Artificial Sequence
  Synthetic Polynucleotide
atatgcagactctccac

SEQ ID NO: 7929 - DNA, 19 bp, Artificial Sequence
  Synthetic Polynucleotide
gtctttccccgttcaggaa

SEQ ID NO: 7930 - DNA, 19 bp, Artificial Sequence
  Synthetic Polynucleotide
ttagccagaccgcactaca

SEQ ID NO: 7931 - DNA, 18 bp, Artificial Sequence
  Synthetic Polynucleotide
cagatttacaacgtgcca

SEQ ID NO: 7932 - DNA, 19 bp, Artificial Sequence
  Synthetic Polynucleotide
gatcgaaatgtgttgagtc

SEQ ID NO: 7933 - DNA, 17 bp, Artificial Sequence
  Synthetic Polynucleotide
taccgtgacatacaact

SEQ ID NO: 7934 - DNA, 18 bp, Artificial Sequence
  Synthetic Polynucleotide
gttttcatgccccagaga

SEQ ID NO: 7935 - DNA, 19 bp, Artificial Sequence
  Synthetic Polynucleotide
cgccaagttatcccggttt

SEQ ID NO: 7936 - DNA, 19 bp, Artificial Sequence
  Synthetic Polynucleotide
attgcccattccacagata

SEQ ID NO: 7937 - DNA, 18 bp, Artificial Sequence
  Synthetic Polynucleotide
gcgatctcttttgtccgc

SEQ ID NO: 7938 - DNA, 18 bp, Artificial Sequence
  Synthetic Polynucleotide
accataggcccgagaaga

SEQ ID NO: 7939 - DNA, 20 bp, Artificial Sequence
  Synthetic Polynucleotide
cgtgagtaatttaacgacgg

SEQ ID NO: 7940 - DNA, 20 bp, Artificial Sequence
  Synthetic Polynucleotide
tttccacatgtttgcccaga

SEQ ID NO: 7941 - DNA, 19 bp, Artificial Sequence
  Synthetic Polynucleotide
ttcaacttttagtttgccc

SEQ ID NO: 7942 - DNA, 19 bp, Artificial Sequence
  Synthetic Polynucleotide
acacagaggttttccctct

SEQ ID NO: 7943 - DNA, 19 bp, Artificial Sequence
  Synthetic Polynucleotide
gagtagttcccgtacccgc

SEQ ID NO: 7944 - DNA, 20 bp, Artificial Sequence
  Synthetic Polynucleotide
catccacatccccttcagat

SEQ ID NO: 7945 - DNA, 20 bp, Artificial Sequence
  Synthetic Polynucleotide
gtcacaattccagaaaccat

SEQ ID NO: 7946 - DNA, 17 bp, Artificial Sequence
  Synthetic Polynucleotide
caagtaacgtcccactt

SEQ ID NO: 7947 - DNA, 17 bp, Artificial Sequence
  Synthetic Polynucleotide
ctgccccgctatgacac

SEQ ID NO: 7948 - DNA, 17 bp, Artificial Sequence
  Synthetic Polynucleotide
tctccatcctgcttgtg

SEQ ID NO: 7949 - DNA, 19 bp, Artificial Sequence
  Synthetic Polynucleotide
cgctattacaagtcagaac

SEQ ID NO: 7950 - DNA, 19 bp, Artificial Sequence
  Synthetic Polynucleotide
acttttcccctcactgttc

SEQ ID NO: 7951 - DNA, 19 bp, Artificial Sequence
  Synthetic Polynucleotide
aacttcgaccagtacagat

SEQ ID NO: 7952 - DNA, 17 bp, Artificial Sequence
  Synthetic Polynucleotide
agagacagcccgccttc

SEQ ID NO: 7953 - DNA, 18 bp, Artificial Sequence
  Synthetic Polynucleotide
cagattagtgattcccgc

SEQ ID NO: 7954 - DNA, 17 bp, Artificial Sequence
  Synthetic Polynucleotide
acgcataccaactcgca

SEQ ID NO: 7955 - DNA, 17 bp, Artificial Sequence
  Synthetic Polynucleotide
gacgcacagagccaaca

SEQ ID NO: 7956 - DNA, 19 bp, Artificial Sequence
  Synthetic Polynucleotide
acacaatcatccccattgt

SEQ ID NO: 7957 - DNA, 18 bp, Artificial Sequence
  Synthetic Polynucleotide
aaccttcgccatgactgt

SEQ ID NO: 7958 - DNA, 19 bp, Artificial Sequence
  Synthetic Polynucleotide
agtgatcatgcactccgta

SEQ ID NO: 7959 - DNA, 17 bp, Artificial Sequence
  Synthetic Polynucleotide
atggttccattggcggt

SEQ ID NO: 7960 - DNA, 17 bp, Artificial Sequence
  Synthetic Polynucleotide
aacaacccaattacccc

SEQ ID NO: 7961 - DNA, 17 bp, Artificial Sequence
  Synthetic Polynucleotide
ggctgtagaatgagcgg

SEQ ID NO: 7962 - DNA, 20 bp, Artificial Sequence
  Synthetic Polynucleotide
gtagctggtataggttcaag

SEQ ID NO: 7963 - DNA, 18 bp, Artificial Sequence
  Synthetic Polynucleotide
gccctccagtttgaacat

SEQ ID NO: 7964 - DNA, 18 bp, Artificial Sequence
  Synthetic Polynucleotide
ggaacaattctccgagtc

SEQ ID NO: 7965 - DNA, 17 bp, Artificial Sequence
  Synthetic Polynucleotide
cagcaaagcccagaaga

SEQ ID NO: 7966 - DNA, 20 bp, Artificial Sequence
  Synthetic Polynucleotide
ggaggcgtcaaatcctattg

SEQ ID NO: 7967 - DNA, 19 bp, Artificial Sequence
  Synthetic Polynucleotide
ctcaccaaaatcgtgctag

SEQ ID NO: 7968 - DNA, 20 bp, Artificial Sequence
  Synthetic Polynucleotide
cataatgcgtggactattct

SEQ ID NO: 7969 - DNA, 17 bp, Artificial Sequence
  Synthetic Polynucleotide
agtgattgaccatcacg

SEQ ID NO: 7970 - DNA, 17 bp, Artificial Sequence
  Synthetic Polynucleotide
gttcatgtccccactca

SEQ ID NO: 7971 - DNA, 17 bp, Artificial Sequence
  Synthetic Polynucleotide
aagccttgtcgagactc

SEQ ID NO: 7972 - DNA, 18 bp, Artificial Sequence
  Synthetic Polynucleotide
accctaccaaaatccacc

SEQ ID NO: 7973 - DNA, 18 bp, Artificial Sequence
  Synthetic Polynucleotide
gatgtggccctatctaaa

SEQ ID NO: 7974 - DNA, 18 bp, Artificial Sequence
  Synthetic Polynucleotide
ctcgcacctgtttattga

SEQ ID NO: 7975 - DNA, 19 bp, Artificial Sequence
  Synthetic Polynucleotide
aatcattagctgatcgagc

SEQ ID NO: 7976 - DNA, 18 bp, Artificial Sequence
  Synthetic Polynucleotide
cggttccctgttttatta

SEQ ID NO: 7977 - DNA, 18 bp, Artificial Sequence
  Synthetic Polynucleotide
ggttgccttcttgtgttc

SEQ ID NO: 7978 - DNA, 18 bp, Artificial Sequence
  Synthetic Polynucleotide
gtacccgtgtgaacttat

SEQ ID NO: 7979 - DNA, 20 bp, Artificial Sequence
  Synthetic Polynucleotide
tgctgatattatcgaacatg

SEQ ID NO: 7980 - DNA, 19 bp, Artificial Sequence
  Synthetic Polynucleotide
cctacgacccttttaaact

SEQ ID NO: 7981 - DNA, 17 bp, Artificial Sequence
  Synthetic Polynucleotide
gttgcaaaacgtatcgt

SEQ ID NO: 7982 - DNA, 18 bp, Artificial Sequence
  Synthetic Polynucleotide
gaagcactctgtgggtaa

SEQ ID NO: 7983 - DNA, 18 bp, Artificial Sequence
  Synthetic Polynucleotide
gtacgtgctgtaatctcc

SEQ ID NO: 7984 - DNA, 19 bp, Artificial Sequence
  Synthetic Polynucleotide
gatttcgggacttgggttg

SEQ ID NO: 7985 - DNA, 18 bp, Artificial Sequence
  Synthetic Polynucleotide
ctatggtgggaatacgtc

SEQ ID NO: 7986 - DNA, 18 bp, Artificial Sequence
  Synthetic Polynucleotide
ttaggctgctgacggatg

SEQ ID NO: 7987 - DNA, 18 bp, Artificial Sequence
  Synthetic Polynucleotide
atgaagcaatcggtaggt

SEQ ID NO: 7988 - DNA, 20 bp, Artificial Sequence
  Synthetic Polynucleotide
tgaagaaatcactgtaaggc

SEQ ID NO: 7989 - DNA, 18 bp, Artificial Sequence
  Synthetic Polynucleotide
ccttcgccaatgacggtg

SEQ ID NO: 7990 - DNA, 18 bp, Artificial Sequence
  Synthetic Polynucleotide
ccactcaaaacggtatgc

SEQ ID NO: 7991 - DNA, 17 bp, Artificial Sequence
  Synthetic Polynucleotide
gctgactacggtcggtg

SEQ ID NO: 7992 - DNA, 19 bp, Artificial Sequence
  Synthetic Polynucleotide
agtggtgggagttgaagtc

SEQ ID NO: 7993 - DNA, 18 bp, Artificial Sequence
  Synthetic Polynucleotide
ctggacgagacctctctc

SEQ ID NO: 7994 - DNA, 18 bp, Artificial Sequence
  Synthetic Polynucleotide
atcaggtaaggaagctgt

SEQ ID NO: 7995 - DNA, 17 bp, Artificial Sequence
  Synthetic Polynucleotide
ttgtcgaacttggacag

SEQ ID NO: 7996 - DNA, 17 bp, Artificial Sequence
  Synthetic Polynucleotide
cacttgatgagacggac

SEQ ID NO: 7997 - DNA, 17 bp, Artificial Sequence
  Synthetic Polynucleotide
ggctggatgccaatact

SEQ ID NO: 7998 - DNA, 17 bp, Artificial Sequence
  Synthetic Polynucleotide
ggactgttgggaacgta

SEQ ID NO: 7999 - DNA, 20 bp, Artificial Sequence
  Synthetic Polynucleotide
cgtgtcttagggaaccaaat

SEQ ID NO: 8000 - DNA, 19 bp, Artificial Sequence
  Synthetic Polynucleotide
ttacttgaggagtaaccat

SEQ ID NO: 8001 - DNA, 20 bp, Artificial Sequence
  Synthetic Polynucleotide
ggaaattgcgtggtgtattg

SEQ ID NO: 8002 - DNA, 17 bp, Artificial Sequence
  Synthetic Polynucleotide
gtaggtgtgtgtcgcct

SEQ ID NO: 8003 - DNA, 17 bp, Artificial Sequence
  Synthetic Polynucleotide
aagttgggtcaatgagc

SEQ ID NO: 8004 - DNA, 19 bp, Artificial Sequence
  Synthetic Polynucleotide
cacttataaaggtggggaa

SEQ ID NO: 8005 - DNA, 20 bp, Artificial Sequence
  Synthetic Polynucleotide
ttatagacggtacaaaacta

SEQ ID NO: 8006 - DNA, 20 bp, Artificial Sequence
  Synthetic Polynucleotide
gggaatgtgttataggaaac

SEQ ID NO: 8007 - DNA, 18 bp, Artificial Sequence
  Synthetic Polynucleotide
aacgagtttgttgggtaa

SEQ ID NO: 8008 - DNA, 18 bp, Artificial Sequence
  Synthetic Polynucleotide
actcttgttcttgatgcc

SEQ ID NO: 8009 - DNA, 17 bp, Artificial Sequence
  Synthetic Polynucleotide
caatcggggtggtgagg

SEQ ID NO: 8010 - DNA, 18 bp, Artificial Sequence
  Synthetic Polynucleotide
gttgtgtttgtgaagtcg

SEQ ID NO: 8011 - DNA, 20 bp, Artificial Sequence
  Synthetic Polynucleotide
gagaagcaatcaatcaaata

SEQ ID NO: 8012 - DNA, 19 bp, Artificial Sequence
  Synthetic Polynucleotide
atacgaatcctgttgacta

SEQ ID NO: 8013 - DNA, 19 bp, Artificial Sequence
  Synthetic Polynucleotide
acttttccgagatagctga

SEQ ID NO: 8014 - DNA, 17 bp, Artificial Sequence
  Synthetic Polynucleotide
ggaatccatccgaagaa

SEQ ID NO: 8015 - DNA, 19 bp, Artificial Sequence
  Synthetic Polynucleotide
ttgaagccttgactgaaac

SEQ ID NO: 8016 - DNA, 19 bp, Artificial Sequence
  Synthetic Polynucleotide
gccgaccttttccttgcac

SEQ ID NO: 8017 - DNA, 18 bp, Artificial Sequence
  Synthetic Polynucleotide
acggtatcgagagaatgg

SEQ ID NO: 8018 - DNA, 19 bp, Artificial Sequence
  Synthetic Polynucleotide
cctgcctgaacctctcctc

SEQ ID NO: 8019 - DNA, 19 bp, Artificial Sequence
  Synthetic Polynucleotide
ccaatacccatcagtagca

SEQ ID NO: 8020 - DNA, 17 bp, Artificial Sequence
  Synthetic Polynucleotide
tccacccgacattgtaa

SEQ ID NO: 8021 - DNA, 19 bp, Artificial Sequence
  Synthetic Polynucleotide
acgacccagtgttcaatag

SEQ ID NO: 8022 - DNA, 20 bp, Artificial Sequence
  Synthetic Polynucleotide
gcgcacgatttcatagcaat

SEQ ID NO: 8023 - DNA, 19 bp, Artificial Sequence
  Synthetic Polynucleotide
gatcatctcacgctcacag

SEQ ID NO: 8024 - DNA, 19 bp, Artificial Sequence
  Synthetic Polynucleotide
gctgtcatctatagttgtg

SEQ ID NO: 8025 - DNA, 20 bp, Artificial Sequence
  Synthetic Polynucleotide
tgttgcccataatagagttc

SEQ ID NO: 8026 - DNA, 19 bp, Artificial Sequence
  Synthetic Polynucleotide
tagttggtcaccttagtgt

SEQ ID NO: 8027 - DNA, 17 bp, Artificial Sequence
  Synthetic Polynucleotide
ctgctcccagcctgaaa

SEQ ID NO: 8028 - DNA, 19 bp, Artificial Sequence
  Synthetic Polynucleotide
agtgaagcaattcagactc

SEQ ID NO: 8029 - DNA, 17 bp, Artificial Sequence
  Synthetic Polynucleotide
caacacaaagtcaacga

SEQ ID NO: 8030 - DNA, 17 bp, Artificial Sequence
  Synthetic Polynucleotide
gaggcaatggtgacggc

SEQ ID NO: 8031 - DNA, 17 bp, Artificial Sequence
  Synthetic Polynucleotide
ggccacttctccctccg

SEQ ID NO: 8032 - DNA, 19 bp, Artificial Sequence
  Synthetic Polynucleotide
ggttttgagatggacgtgc

SEQ ID NO: 8033 - DNA, 19 bp, Artificial Sequence
  Synthetic Polynucleotide
aacacaaagtcaatgatgg

SEQ ID NO: 8034 - DNA, 19 bp, Artificial Sequence
  Synthetic Polynucleotide
atcctgtgaagtccgtgac

SEQ ID NO: 8035 - DNA, 18 bp, Artificial Sequence
  Synthetic Polynucleotide
gctctcttccaagaccca

SEQ ID NO: 8036 - DNA, 20 bp, Artificial Sequence
  Synthetic Polynucleotide
gcatgagattcggaagtcgt

SEQ ID NO: 8037 - DNA, 18 bp, Artificial Sequence
  Synthetic Polynucleotide
agcaacaaacccgagcac

SEQ ID NO: 8038 - DNA, 17 bp, Artificial Sequence
  Synthetic Polynucleotide
gtgttgtcgtcgtaggt

SEQ ID NO: 8039 - DNA, 18 bp, Artificial Sequence
  Synthetic Polynucleotide
cgcaattctaacctcgtc

SEQ ID NO: 8040 - DNA, 18 bp, Artificial Sequence
  Synthetic Polynucleotide
ggctgaacaaggatggag

SEQ ID NO: 8041 - DNA, 20 bp, Artificial Sequence
  Synthetic Polynucleotide
gttctctttcctaactccac

SEQ ID NO: 8042 - DNA, 19 bp, Artificial Sequence
  Synthetic Polynucleotide
gtcaacgcagatcatcagt

SEQ ID NO: 8043 - DNA, 19 bp, Artificial Sequence
  Synthetic Polynucleotide
ctggcttttcgttctctct

SEQ ID NO: 8044 - DNA, 18 bp, Artificial Sequence
  Synthetic Polynucleotide
gatgttggtgagcctagg

SEQ ID NO: 8045 - DNA, 18 bp, Artificial Sequence
  Synthetic Polynucleotide
ctctcttcttctttccca

SEQ ID NO: 8046 - DNA, 20 bp, Artificial Sequence
  Synthetic Polynucleotide
acatagtatccgcagaacag

SEQ ID NO: 8047 - DNA, 18 bp, Artificial Sequence
  Synthetic Polynucleotide
gcagtcctcgaacaagac

SEQ ID NO: 8048 - DNA, 17 bp, Artificial Sequence
  Synthetic Polynucleotide
tatcaaatcctcctcgt

SEQ ID NO: 8049 - DNA, 18 bp, Artificial Sequence
  Synthetic Polynucleotide
tttgatgcgtttcttacc

SEQ ID NO: 8050 - DNA, 17 bp, Artificial Sequence
  Synthetic Polynucleotide
tccaactcccacgccat

SEQ ID NO: 8051 - DNA, 17 bp, Artificial Sequence
  Synthetic Polynucleotide
aggggctcgttggtcca

SEQ ID NO: 8052 - DNA, 18 bp, Artificial Sequence
  Synthetic Polynucleotide
tggggttcctaaacttgt

SEQ ID NO: 8053 - DNA, 17 bp, Artificial Sequence
  Synthetic Polynucleotide
tacatgcacatcgccgg

SEQ ID NO: 8054 - DNA, 17 bp, Artificial Sequence
  Synthetic Polynucleotide
gctatcatcccatttgc

SEQ ID NO: 8055 - DNA, 18 bp, Artificial Sequence
  Synthetic Polynucleotide
ctccttcttcaggatgaa

SEQ ID NO: 8056 - DNA, 17 bp, Artificial Sequence
  Synthetic Polynucleotide
aagaactggttgcttgg

SEQ ID NO: 8057 - DNA, 17 bp, Artificial Sequence
  Synthetic Polynucleotide
atggtcttacatgcaca

SEQ ID NO: 8058 - DNA, 18 bp, Artificial Sequence
  Synthetic Polynucleotide
tgacctcttccttctctt

SEQ ID NO: 8059 - DNA, 18 bp, Artificial Sequence
  Synthetic Polynucleotide
tgactcggggtaatattg

SEQ ID NO: 8060 - DNA, 18 bp, Artificial Sequence
  Synthetic Polynucleotide
agggtagaaattgtagcg

SEQ ID NO: 8061 - DNA, 18 bp, Artificial Sequence
  Synthetic Polynucleotide
atagcggatactattcgg

SEQ ID NO: 8062 - DNA, 17 bp, Artificial Sequence
  Synthetic Polynucleotide
acgttttcactgacggt

SEQ ID NO: 8063 - DNA, 17 bp, Artificial Sequence
  Synthetic Polynucleotide
caggtgtactggtccct

SEQ ID NO: 8064 - DNA, 17 bp, Artificial Sequence
  Synthetic Polynucleotide
atgctgcttcttccttc

SEQ ID NO: 8065 - DNA, 18 bp, Artificial Sequence
  Synthetic Polynucleotide
gacatggtttggttttgt

SEQ ID NO: 8066 - DNA, 17 bp, Artificial Sequence
  Synthetic Polynucleotide
ggcttggttccacatgc

SEQ ID NO: 8067 - DNA, 18 bp, Artificial Sequence
  Synthetic Polynucleotide
aacaggccgaactttatc

SEQ ID NO: 8068 - DNA, 18 bp, Artificial Sequence
  Synthetic Polynucleotide
ccctcttaccttggtgta

SEQ ID NO: 8069 - DNA, 18 bp, Artificial Sequence
  Synthetic Polynucleotide
tctgctttctcttttgct

SEQ ID NO: 8070 - DNA, 17 bp, Artificial Sequence
  Synthetic Polynucleotide
aagctccactcataggt

SEQ ID NO: 8071 - DNA, 17 bp, Artificial Sequence
  Synthetic Polynucleotide
cccttcaatcatcaccg

SEQ ID NO: 8072 - DNA, 18 bp, Artificial Sequence
  Synthetic Polynucleotide
cgacgttgaaacatacac

SEQ ID NO: 8073 - DNA, 18 bp, Artificial Sequence
  Synthetic Polynucleotide
atctttccgtttctgggc

SEQ ID NO: 8074 - DNA, 17 bp, Artificial Sequence
  Synthetic Polynucleotide
ctgtgagtaacactggc

SEQ ID NO: 8075 - DNA, 17 bp, Artificial Sequence
  Synthetic Polynucleotide
gttcctggtccaaatgt

SEQ ID NO: 8076 - DNA, 18 bp, Artificial Sequence
  Synthetic Polynucleotide
tttgatcattggtggcat

SEQ ID NO: 8077 - DNA, 18 bp, Artificial Sequence
  Synthetic Polynucleotide
aatctattgctgttgcca

SEQ ID NO: 8078 - DNA, 18 bp, Artificial Sequence
  Synthetic Polynucleotide
ctagttgtcccatttcca

SEQ ID NO: 8079 - DNA, 18 bp, Artificial Sequence
  Synthetic Polynucleotide
tccagatccattagaacc

SEQ ID NO: 8080 - DNA, 17 bp, Artificial Sequence
  Synthetic Polynucleotide
gatgcaatgccaggagt

SEQ ID NO: 8081 - DNA, 17 bp, Artificial Sequence
  Synthetic Polynucleotide
actggggaggcactgct

SEQ ID NO: 8082 - DNA, 17 bp, Artificial Sequence
  Synthetic Polynucleotide
tttgtttggggagatga

SEQ ID NO: 8083 - DNA, 18 bp, Artificial Sequence
  Synthetic Polynucleotide
tctaggttcacagcacct

SEQ ID NO: 8084 - DNA, 18 bp, Artificial Sequence
  Synthetic Polynucleotide
caaggctccgatgacatc

SEQ ID NO: 8085 - DNA, 18 bp, Artificial Sequence
  Synthetic Polynucleotide
tggagagtcagggaggcc

SEQ ID NO: 8086 - DNA, 18 bp, Artificial Sequence
  Synthetic Polynucleotide
gtggatgcaatgagtcaa

SEQ ID NO: 8087 - DNA, 17 bp, Artificial Sequence
  Synthetic Polynucleotide
agctaggtcaaagctct

SEQ ID NO: 8088 - DNA, 18 bp, Artificial Sequence
  Synthetic Polynucleotide
tgttgaacttgagtcctg

SEQ ID NO: 8089 - DNA, 18 bp, Artificial Sequence
  Synthetic Polynucleotide
ctttccatttcttctcga

SEQ ID NO: 8090 - DNA, 17 bp, Artificial Sequence
  Synthetic Polynucleotide
tcatgtttgatgcaaca

SEQ ID NO: 8091 - DNA, 17 bp, Artificial Sequence
  Synthetic Polynucleotide
gattggttgtgggagag

SEQ ID NO: 8092 - DNA, 18 bp, Artificial Sequence
  Synthetic Polynucleotide
gtgaggggttatttcctc

SEQ ID NO: 8093 - DNA, 17 bp, Artificial Sequence
  Synthetic Polynucleotide
tcaataacaggaagggc

SEQ ID NO: 8094 - DNA, 17 bp, Artificial Sequence
  Synthetic Polynucleotide
tcacaaatactcgggag

SEQ ID NO: 8095 - DNA, 17 bp, Artificial Sequence
  Synthetic Polynucleotide
tccagattgtgtctgat

SEQ ID NO: 8096 - DNA, 17 bp, Artificial Sequence
  Synthetic Polynucleotide
gtgatccaatcgttgtc

SEQ ID NO: 8097 - DNA, 18 bp, Artificial Sequence
  Synthetic Polynucleotide
atcgatgttcttgatgct

SEQ ID NO: 8098 - DNA, 18 bp, Artificial Sequence
  Synthetic Polynucleotide
acaatgtgtctatgggtt

SEQ ID NO: 8099 - DNA, 18 bp, Artificial Sequence
  Synthetic Polynucleotide
agagatgctacaaaagga

SEQ ID NO: 8100 - DNA, 18 bp, Artificial Sequence
  Synthetic Polynucleotide
ctggtcttgtttctggtt

SEQ ID NO: 8101 - DNA, 17 bp, Artificial Sequence
  Synthetic Polynucleotide
aatgaatggttgtggga

SEQ ID NO: 8102 - DNA, 18 bp, Artificial Sequence
  Synthetic Polynucleotide
tgagttgggtgtttgggt

SEQ ID NO: 8103 - DNA, 17 bp, Artificial Sequence
  Synthetic Polynucleotide
agcaccatcttcagatg

SEQ ID NO: 8104 - DNA, 17 bp, Artificial Sequence
  Synthetic Polynucleotide
catgttcgtggatgaga

SEQ ID NO: 8105 - DNA, 18 bp, Artificial Sequence
  Synthetic Polynucleotide
tagaagtccaggttgggc

SEQ ID NO: 8106 - DNA, 18 bp, Artificial Sequence
  Synthetic Polynucleotide
ctcacagaatagaaggga

SEQ ID NO: 8107 - DNA, 17 bp, Artificial Sequence
  Synthetic Polynucleotide
agaggtggagagtcagg

SEQ ID NO: 8108 - DNA, 18 bp, Artificial Sequence
  Synthetic Polynucleotide
agttcagagagatgtggt

SEQ ID NO: 8109 - DNA, 17 bp, Artificial Sequence
  Synthetic Polynucleotide
tgattgttcttgggtga

SEQ ID NO: 8110 - DNA, 18 bp, Artificial Sequence
  Synthetic Polynucleotide
tggcttatatccaatggg

SEQ ID NO: 8111 - DNA, 18 bp, Artificial Sequence
  Synthetic Polynucleotide
gggagtagtcgttgagaa

SEQ ID NO: 8112 - DNA, 18 bp, Artificial Sequence
  Synthetic Polynucleotide
ttataggcaagagggagt

SEQ ID NO: 8113 - DNA, 17 bp, Artificial Sequence
  Synthetic Polynucleotide
gccaaagagatgctaga

SEQ ID NO: 8114 - DNA, 18 bp, Artificial Sequence
  Synthetic Polynucleotide
ctcggttgacattctaca

SEQ ID NO: 8115 - DNA, 18 bp, Artificial Sequence
  Synthetic Polynucleotide
agagaatatgaggcaaga

SEQ ID NO: 8116 - DNA, 18 bp, Artificial Sequence
  Synthetic Polynucleotide
ggaaaagtttgggcactt

SEQ ID NO: 8117 - DNA, 18 bp, Artificial Sequence
  Synthetic Polynucleotide
taagagtggttttggaat

SEQ ID NO: 8118 - DNA, 17 bp, Artificial Sequence
  Synthetic Polynucleotide
cctgaaagcgggaacta

SEQ ID NO: 8119 - DNA, 17 bp, Artificial Sequence
  Synthetic Polynucleotide
gtttctcacagagtgga

SEQ ID NO: 8120 - DNA, 17 bp, Artificial Sequence
  Synthetic Polynucleotide
gatgggttgggattcca

SEQ ID NO: 8121 - DNA, 17 bp, Artificial Sequence
  Synthetic Polynucleotide
tagttttcaaagctgcc

SEQ ID NO: 8122 - DNA, 17 bp, Artificial Sequence
  Synthetic Polynucleotide
ttgttatgttggctggg

SEQ ID NO: 8123 - DNA, 18 bp, Artificial Sequence
  Synthetic Polynucleotide
tgtggggtttagggcaag

SEQ ID NO: 8124 - DNA, 17 bp, Artificial Sequence
  Synthetic Polynucleotide
gcgaaaggaatatgcag

SEQ ID NO: 8125 - DNA, 17 bp, Artificial Sequence
  Synthetic Polynucleotide
ggtccgatgacataagg

SEQ ID NO: 8126 - DNA, 18 bp, Artificial Sequence
  Synthetic Polynucleotide
ggtctttgtactgatccc

SEQ ID NO: 8127 - DNA, 18 bp, Artificial Sequence
  Synthetic Polynucleotide
tcagtttgggacaatgcc

SEQ ID NO: 8128 - DNA, 18 bp, Artificial Sequence
  Synthetic Polynucleotide
gaatttgggtacttcgcg

SEQ ID NO: 8129 - DNA, 18 bp, Artificial Sequence
  Synthetic Polynucleotide
aacagggttcttcacgtc

SEQ ID NO: 8130 - DNA, 18 bp, Artificial Sequence
  Synthetic Polynucleotide
aagataggtatgcacaca

SEQ ID NO: 8131 - DNA, 18 bp, Artificial Sequence
  Synthetic Polynucleotide
tttctgcaagggctaagg

SEQ ID NO: 8132 - DNA, 18 bp, Artificial Sequence
  Synthetic Polynucleotide
aaaataggggtccgaatc

SEQ ID NO: 8133 - DNA, 18 bp, Artificial Sequence
  Synthetic Polynucleotide
aatggtcttaacagaggg

SEQ ID NO: 8134 - DNA, 18 bp, Artificial Sequence
  Synthetic Polynucleotide
tacttgttttagagaggc

SEQ ID NO: 8135 - DNA, 18 bp, Artificial Sequence
  Synthetic Polynucleotide
atcaaggctagaggggtg

SEQ ID NO: 8136 - DNA, 17 bp, Artificial Sequence
  Synthetic Polynucleotide
tgttttgggaacacagc

SEQ ID NO: 8137 - DNA, 18 bp, Artificial Sequence
  Synthetic Polynucleotide
atgttgtacaggctttta

SEQ ID NO: 8138 - DNA, 18 bp, Artificial Sequence
  Synthetic Polynucleotide
tcatcatcactagaggta

SEQ ID NO: 8139 - DNA, 17 bp, Artificial Sequence
  Synthetic Polynucleotide
atggggagagaaaggta

SEQ ID NO: 8140 - DNA, 18 bp, Artificial Sequence
  Synthetic Polynucleotide
ttagtctatcaggcgtct

SEQ ID NO: 8141 - DNA, 18 bp, Artificial Sequence
  Synthetic Polynucleotide
tgcaatgttggttaggtt

SEQ ID NO: 8142 - DNA, 18 bp, Artificial Sequence
  Synthetic Polynucleotide
tcactactttagaggtcc

SEQ ID NO: 8143 - DNA, 18 bp, Artificial Sequence
  Synthetic Polynucleotide
ggttgggatttaggatgg

SEQ ID NO: 8144 - DNA, 17 bp, Artificial Sequence
  Synthetic Polynucleotide
gtaggttgagggtcata

SEQ ID NO: 8145 - DNA, 17 bp, Artificial Sequence
  Synthetic Polynucleotide
aacaagctcagagaggg

SEQ ID NO: 8146 - DNA, 18 bp, Artificial Sequence
  Synthetic Polynucleotide
aaggttgacagaggatag

SEQ ID NO: 8147 - DNA, 18 bp, Artificial Sequence
  Synthetic Polynucleotide
catgttgtttggaaggtg

SEQ ID NO: 8148 - DNA, 18 bp, Artificial Sequence
  Synthetic Polynucleotide
ctgttgatcttgagggca

SEQ ID NO: 8149 - DNA, 18 bp, Artificial Sequence
  Synthetic Polynucleotide
ccatacttgacatgggtc

SEQ ID NO: 8150 - DNA, 18 bp, Artificial Sequence
  Synthetic Polynucleotide
ctttatgttgtgtagggc

SEQ ID NO: 8151 - DNA, 18 bp, Artificial Sequence
  Synthetic Polynucleotide
caagctaatgctcttctc

SEQ ID NO: 8152 - DNA, 17 bp, Artificial Sequence
  Synthetic Polynucleotide
tggggacatttacttgg

SEQ ID NO: 8153 - DNA, 18 bp, Artificial Sequence
  Synthetic Polynucleotide
gctggttgataaggaatg

SEQ ID NO: 8154 - DNA, 18 bp, Artificial Sequence
  Synthetic Polynucleotide
aggtaagggacaggcttc

SEQ ID NO: 8155 - DNA, 17 bp, Artificial Sequence
  Synthetic Polynucleotide
tggtggggaattttgtt

SEQ ID NO: 8156 - DNA, 17 bp, Artificial Sequence
  Synthetic Polynucleotide
cttggttgacaatggtc

SEQ ID NO: 8157 - DNA, 17 bp, Artificial Sequence
  Synthetic Polynucleotide
tgggtgtttgggtctta

SEQ ID NO: 8158 - DNA, 18 bp, Artificial Sequence
  Synthetic Polynucleotide
aaaattttggggtacagc

SEQ ID NO: 8159 - DNA, 18 bp, Artificial Sequence
  Synthetic Polynucleotide
gccattttctaggagaca

SEQ ID NO: 8160 - DNA, 18 bp, Artificial Sequence
  Synthetic Polynucleotide
tggattgaagggaactag

SEQ ID NO: 8161 - DNA, 17 bp, Artificial Sequence
  Synthetic Polynucleotide
ctcaggagagaacttgg

SEQ ID NO: 8162 - DNA, 18 bp, Artificial Sequence
  Synthetic Polynucleotide
tcatacaggctagagtga

SEQ ID NO: 8163 - DNA, 17 bp, Artificial Sequence
  Synthetic Polynucleotide
ttccgaatcgtggtcaa

SEQ ID NO: 8164 - DNA, 17 bp, Artificial Sequence
  Synthetic Polynucleotide
ggttggcttacttgagt

SEQ ID NO: 8165 - DNA, 18 bp, Artificial Sequence
  Synthetic Polynucleotide
ccgggatgtttatacaga

SEQ ID NO: 8166 - DNA, 18 bp, Artificial Sequence
  Synthetic Polynucleotide
cctttagggttagtggac

SEQ ID NO: 8167 - DNA, 18 bp, Artificial Sequence
  Synthetic Polynucleotide
ttgatgcaatgtaaggcc

SEQ ID NO: 8168 - DNA, 18 bp, Artificial Sequence
  Synthetic Polynucleotide
ccagtttgggacaatgcc

SEQ ID NO: 8169 - DNA, 17 bp, Artificial Sequence
  Synthetic Polynucleotide
ggctcagggtttactaa

SEQ ID NO: 8170 - DNA, 18 bp, Artificial Sequence
  Synthetic Polynucleotide
ggaaaagtgggttattcc

SEQ ID NO: 8171 - DNA, 17 bp, Artificial Sequence
  Synthetic Polynucleotide
ttcggtgtagtttccac

SEQ ID NO: 8172 - DNA, 18 bp, Artificial Sequence
  Synthetic Polynucleotide
gattcttaacaatgggcc

SEQ ID NO: 8173 - DNA, 18 bp, Artificial Sequence
  Synthetic Polynucleotide
cgccctaattgaataggt

SEQ ID NO: 8174 - DNA, 17 bp, Artificial Sequence
  Synthetic Polynucleotide
ggccagccagtcaatca

SEQ ID NO: 8175 - DNA, 18 bp, Artificial Sequence
  Synthetic Polynucleotide
gagatgtcacaaacgtag

SEQ ID NO: 8176 - DNA, 18 bp, Artificial Sequence
  Synthetic Polynucleotide
gatgctaggttagccatt

SEQ ID NO: 8177 - DNA, 17 bp, Artificial Sequence
  Synthetic Polynucleotide
gttggaggaagttgtga

SEQ ID NO: 8178 - DNA, 18 bp, Artificial Sequence
  Synthetic Polynucleotide
cctttaaccatgtctggg

SEQ ID NO: 8179 - DNA, 17 bp, Artificial Sequence
  Synthetic Polynucleotide
gagccacctttgtcagg

SEQ ID NO: 8180 - DNA, 18 bp, Artificial Sequence
  Synthetic Polynucleotide
cggtttgggtcaaaagtt

SEQ ID NO: 8181 - DNA, 18 bp, Artificial Sequence
  Synthetic Polynucleotide
gatgcgagatgcaagagg

SEQ ID NO: 8182 - DNA, 17 bp, Artificial Sequence
  Synthetic Polynucleotide
cgtgcttattggtatgc

SEQ ID NO: 8183 - DNA, 17 bp, Artificial Sequence
  Synthetic Polynucleotide
taacacgggaaagatga

SEQ ID NO: 8184 - DNA, 17 bp, Artificial Sequence
  Synthetic Polynucleotide
tatcaccatcacagcca

SEQ ID NO: 8185 - DNA, 17 bp, Artificial Sequence
  Synthetic Polynucleotide
gaagacgaacatcacga

SEQ ID NO: 8186 - DNA, 18 bp, Artificial Sequence
  Synthetic Polynucleotide
ccagtcgctcgatacgtt

SEQ ID NO: 8187 - DNA, 18 bp, Artificial Sequence
  Synthetic Polynucleotide
ccgccgctctcatacact

SEQ ID NO: 8188 - DNA, 17 bp, Artificial Sequence
  Synthetic Polynucleotide
tacactacgaaaaccgt

SEQ ID NO: 8189 - DNA, 17 bp, Artificial Sequence
  Synthetic Polynucleotide
ggattccgtttccacca

SEQ ID NO: 8190 - DNA, 18 bp, Artificial Sequence
  Synthetic Polynucleotide
gctgatcgaccatacctg

SEQ ID NO: 8191 - DNA, 17 bp, Artificial Sequence
  Synthetic Polynucleotide
ggttttggtcctgtgac

SEQ ID NO: 8192 - DNA, 17 bp, Artificial Sequence
  Synthetic Polynucleotide
cacagaagagcaactcc

SEQ ID NO: 8193 - DNA, 17 bp, Artificial Sequence
  Synthetic Polynucleotide
ctggcggggttggtggt

SEQ ID NO: 8194 - DNA, 17 bp, Artificial Sequence
  Synthetic Polynucleotide
accttggctcgcttttc

SEQ ID NO: 8195 - DNA, 18 bp, Artificial Sequence
  Synthetic Polynucleotide
caccataggggtctacga

SEQ ID NO: 8196 - DNA, 18 bp, Artificial Sequence
  Synthetic Polynucleotide
agatcatgtggtcagtgg

SEQ ID NO: 8197 - DNA, 18 bp, Artificial Sequence
  Synthetic Polynucleotide
gtgcaacgatatcctgaa

SEQ ID NO: 8198 - DNA, 17 bp, Artificial Sequence
  Synthetic Polynucleotide
catccagagaagagcat

SEQ ID NO: 8199 - DNA, 17 bp, Artificial Sequence
  Synthetic Polynucleotide
agcctgatttgaagggg

SEQ ID NO: 8200 - DNA, 18 bp, Artificial Sequence
  Synthetic Polynucleotide
catgtcaacagtttccac

SEQ ID NO: 8201 - DNA, 18 bp, Artificial Sequence
  Synthetic Polynucleotide
ctctgagattgtcaacga

SEQ ID NO: 8202 - DNA, 18 bp, Artificial Sequence
  Synthetic Polynucleotide
tgcttggtgtccattttg

SEQ ID NO: 8203 - DNA, 17 bp, Artificial Sequence
  Synthetic Polynucleotide
tgggcttgtagaagttc

SEQ ID NO: 8204 - DNA, 17 bp, Artificial Sequence
  Synthetic Polynucleotide
agggaaacttggacccg

SEQ ID NO: 8205 - DNA, 17 bp, Artificial Sequence
  Synthetic Polynucleotide
ccgcacaccatttcttc

SEQ ID NO: 8206 - DNA, 17 bp, Artificial Sequence
  Synthetic Polynucleotide
gccaacgtgcaatgttt

SEQ ID NO: 8207 - DNA, 17 bp, Artificial Sequence
  Synthetic Polynucleotide
tatgcaggaccagtgta

SEQ ID NO: 8208 - DNA, 18 bp, Artificial Sequence
  Synthetic Polynucleotide
ttcctcacgaagtcattc

SEQ ID NO: 8209 - DNA, 17 bp, Artificial Sequence
  Synthetic Polynucleotide
tttgacgaaagcagcag

SEQ ID NO: 8210 - DNA, 17 bp, Artificial Sequence
  Synthetic Polynucleotide
ttcttgtcgtacaccag

SEQ ID NO: 8211 - DNA, 17 bp, Artificial Sequence
  Synthetic Polynucleotide
cgaatccgtgtcgccgt

SEQ ID NO: 8212 - DNA, 17 bp, Artificial Sequence
  Synthetic Polynucleotide
aaaccgctcgccaacta

SEQ ID NO: 8213 - DNA, 18 bp, Artificial Sequence
  Synthetic Polynucleotide
tatgttaatcgccatgtt

SEQ ID NO: 8214 - DNA, 18 bp, Artificial Sequence
  Synthetic Polynucleotide
acgcatacgatatgtcaa

SEQ ID NO: 8215 - DNA, 18 bp, Artificial Sequence
  Synthetic Polynucleotide
gcaaactccttgatcttg

SEQ ID NO: 8216 - DNA, 18 bp, Artificial Sequence
  Synthetic Polynucleotide
ccagacacaatgaagctg

SEQ ID NO: 8217 - DNA, 17 bp, Artificial Sequence
  Synthetic Polynucleotide
ccgttttccttcttgtc

SEQ ID NO: 8218 - DNA, 18 bp, Artificial Sequence
  Synthetic Polynucleotide
ccgtgttgcaaatttcaa

SEQ ID NO: 8219 - DNA, 17 bp, Artificial Sequence
  Synthetic Polynucleotide
ccgtcgtactgtttgaa

SEQ ID NO: 8220 - DNA, 17 bp, Artificial Sequence
  Synthetic Polynucleotide
tcgttcaaaccgatcac

SEQ ID NO: 8221 - DNA, 18 bp, Artificial Sequence
  Synthetic Polynucleotide
ttgtctccgtcgcaatcg

SEQ ID NO: 8222 - DNA, 17 bp, Artificial Sequence
  Synthetic Polynucleotide
cgttttacgccaacgtg

SEQ ID NO: 8223 - DNA, 18 bp, Artificial Sequence
  Synthetic Polynucleotide
tgtgaaaactctcaccgg

SEQ ID NO: 8224 - DNA, 18 bp, Artificial Sequence
  Synthetic Polynucleotide
cgttcacaggctcaagat

SEQ ID NO: 8225 - DNA, 18 bp, Artificial Sequence
  Synthetic Polynucleotide
caacaaatgccaaagcta

SEQ ID NO: 8226 - DNA, 18 bp, Artificial Sequence
  Synthetic Polynucleotide
ttgcatctgtactcgatt

SEQ ID NO: 8227 - DNA, 17 bp, Artificial Sequence
  Synthetic Polynucleotide
ggaaactcccagtcgat

SEQ ID NO: 8228 - DNA, 17 bp, Artificial Sequence
  Synthetic Polynucleotide
tcccgtccccaacctta

SEQ ID NO: 8229 - DNA, 18 bp, Artificial Sequence
  Synthetic Polynucleotide
tcgtccatctaacattct

SEQ ID NO: 8230 - DNA, 18 bp, Artificial Sequence
  Synthetic Polynucleotide
tgcaaactaagcatcctt

SEQ ID NO: 8231 - DNA, 18 bp, Artificial Sequence
  Synthetic Polynucleotide
ctctcctccgcactacag

SEQ ID NO: 8232 - DNA, 18 bp, Artificial Sequence
  Synthetic Polynucleotide
cgtttaatgagaaccacg

SEQ ID NO: 8233 - DNA, 17 bp, Artificial Sequence
  Synthetic Polynucleotide
gtacgcatccaccactt

SEQ ID NO: 8234 - DNA, 18 bp, Artificial Sequence
  Synthetic Polynucleotide
ggccagatttaggaccag

SEQ ID NO: 8235 - DNA, 18 bp, Artificial Sequence
  Synthetic Polynucleotide
tctagtcgaatcaatcgc

SEQ ID NO: 8236 - DNA, 18 bp, Artificial Sequence
  Synthetic Polynucleotide
tcagccaaaggtaaatct

SEQ ID NO: 8237 - DNA, 18 bp, Artificial Sequence
  Synthetic Polynucleotide
accacaaaccatccgcaa

SEQ ID NO: 8238 - DNA, 17 bp, Artificial Sequence
  Synthetic Polynucleotide
acgccaacgaaatcaaa

SEQ ID NO: 8239 - DNA, 18 bp, Artificial Sequence
  Synthetic Polynucleotide
ttaaacccgccagcaatt

SEQ ID NO: 8240 - DNA, 18 bp, Artificial Sequence
  Synthetic Polynucleotide
attgttcaccagttgttc

SEQ ID NO: 8241 - DNA, 17 bp, Artificial Sequence
  Synthetic Polynucleotide
agccgacgaatcataca

SEQ ID NO: 8242 - DNA, 18 bp, Artificial Sequence
  Synthetic Polynucleotide
tcatacctcatattgggg

SEQ ID NO: 8243 - DNA, 17 bp, Artificial Sequence
  Synthetic Polynucleotide
gccttatgccaaaccag

SEQ ID NO: 8244 - DNA, 18 bp, Artificial Sequence
  Synthetic Polynucleotide
aagaggcactaaaagtga

SEQ ID NO: 8245 - DNA, 18 bp, Artificial Sequence
  Synthetic Polynucleotide
ggctaggcgtctgatttt

SEQ ID NO: 8246 - DNA, 18 bp, Artificial Sequence
  Synthetic Polynucleotide
ctaccagtgcagaaagca

SEQ ID NO: 8247 - DNA, 17 bp, Artificial Sequence
  Synthetic Polynucleotide
cccacagctcaggtacc

SEQ ID NO: 8248 - DNA, 17 bp, Artificial Sequence
  Synthetic Polynucleotide
cagctactcaggacagc

SEQ ID NO: 8249 - DNA, 18 bp, Artificial Sequence
  Synthetic Polynucleotide
tagtctagtggtttgtta

SEQ ID NO: 8250 - DNA, 17 bp, Artificial Sequence
  Synthetic Polynucleotide
aatgaggattgctcgga

SEQ ID NO: 8251 - DNA, 17 bp, Artificial Sequence
  Synthetic Polynucleotide
ggccaggggtattctct

SEQ ID NO: 8252 - DNA, 18 bp, Artificial Sequence
  Synthetic Polynucleotide
cacagtacatggagggaa

SEQ ID NO: 8253 - DNA, 18 bp, Artificial Sequence
  Synthetic Polynucleotide
atcagctcgaagttgctc

SEQ ID NO: 8254 - DNA, 18 bp, Artificial Sequence
  Synthetic Polynucleotide
ttgtgattccaaccagcg

SEQ ID NO: 8255 - DNA, 18 bp, Artificial Sequence
  Synthetic Polynucleotide
ggtcagggagtatttgat

SEQ ID NO: 8256 - DNA, 18 bp, Artificial Sequence
  Synthetic Polynucleotide
tgagtgacgttttcaata

SEQ ID NO: 8257 - DNA, 17 bp, Artificial Sequence
  Synthetic Polynucleotide
tgccagtatgttcgtca

SEQ ID NO: 8258 - DNA, 18 bp, Artificial Sequence
  Synthetic Polynucleotide
aaaacaaggaacatctgg

SEQ ID NO: 8259 - DNA, 18 bp, Artificial Sequence
  Synthetic Polynucleotide
tacaaggctaagtatgcc

SEQ ID NO: 8260 - DNA, 18 bp, Artificial Sequence
  Synthetic Polynucleotide
ctacttttcccgaaagga

SEQ ID NO: 8261 - DNA, 18 bp, Artificial Sequence
  Synthetic Polynucleotide
agtgtagcagtctcacca

SEQ ID NO: 8262 - DNA, 18 bp, Artificial Sequence
  Synthetic Polynucleotide
attgttagaccagtcacg

SEQ ID NO: 8263 - DNA, 18 bp, Artificial Sequence
  Synthetic Polynucleotide
gagaaaccgaagaaaaga

SEQ ID NO: 8264 - DNA, 17 bp, Artificial Sequence
  Synthetic Polynucleotide
taatcgtcgttgagacg

SEQ ID NO: 8265 - DNA, 18 bp, Artificial Sequence
  Synthetic Polynucleotide
tctcctatggaaaccctc

SEQ ID NO: 8266 - DNA, 17 bp, Artificial Sequence
  Synthetic Polynucleotide
actcctggtgattgtga

SEQ ID NO: 8267 - DNA, 17 bp, Artificial Sequence
  Synthetic Polynucleotide
gctatgcaagcccatgc

SEQ ID NO: 8268 - DNA, 17 bp, Artificial Sequence
  Synthetic Polynucleotide
tgacacgcagacctctt

SEQ ID NO: 8269 - DNA, 18 bp, Artificial Sequence
  Synthetic Polynucleotide
tgaaactagcacgttgtg

SEQ ID NO: 8270 - DNA, 18 bp, Artificial Sequence
  Synthetic Polynucleotide
cggctaaaatggtcagtc

SEQ ID NO: 8271 - DNA, 18 bp, Artificial Sequence
  Synthetic Polynucleotide
atcttcacgcaacatcta

SEQ ID NO: 8272 - DNA, 18 bp, Artificial Sequence
  Synthetic Polynucleotide
atggttcgactctctcag

SEQ ID NO: 8273 - DNA, 17 bp, Artificial Sequence
  Synthetic Polynucleotide
ctgcactctgaaggtat

SEQ ID NO: 8274 - DNA, 18 bp, Artificial Sequence
  Synthetic Polynucleotide
ggcatctaaactctctcc

SEQ ID NO: 8275 - DNA, 18 bp, Artificial Sequence
  Synthetic Polynucleotide
tggatgcttatacatgct

SEQ ID NO: 8276 - DNA, 18 bp, Artificial Sequence
  Synthetic Polynucleotide
cgaaaactgaattggcat

SEQ ID NO: 8277 - DNA, 18 bp, Artificial Sequence
  Synthetic Polynucleotide
ttaagttggacaaggtcc

SEQ ID NO: 8278 - DNA, 17 bp, Artificial Sequence
  Synthetic Polynucleotide
ctggattggtgaactcc

SEQ ID NO: 8279 - DNA, 17 bp, Artificial Sequence
  Synthetic Polynucleotide
tatttccgagattcccg

SEQ ID NO: 8280 - DNA, 17 bp, Artificial Sequence
  Synthetic Polynucleotide
aatctctctccctgaga

SEQ ID NO: 8281 - DNA, 17 bp, Artificial Sequence
  Synthetic Polynucleotide
catctttgctgctccgg

SEQ ID NO: 8282 - DNA, 18 bp, Artificial Sequence
  Synthetic Polynucleotide
ctgaaaggaaactggcat

SEQ ID NO: 8283 - DNA, 18 bp, Artificial Sequence
  Synthetic Polynucleotide
ttgactaattggtggtgt

SEQ ID NO: 8284 - DNA, 18 bp, Artificial Sequence
  Synthetic Polynucleotide
acagaagctcaagtagtg

SEQ ID NO: 8285 - DNA, 18 bp, Artificial Sequence
  Synthetic Polynucleotide
gaatttcgattcccacta

SEQ ID NO: 8286 - DNA, 17 bp, Artificial Sequence
  Synthetic Polynucleotide
gtctcccctaagagact

SEQ ID NO: 8287 - DNA, 18 bp, Artificial Sequence
  Synthetic Polynucleotide
taaagtgaatgctgctat

SEQ ID NO: 8288 - DNA, 18 bp, Artificial Sequence
  Synthetic Polynucleotide
atcgaagctcctgtacac

SEQ ID NO: 8289 - DNA, 17 bp, Artificial Sequence
  Synthetic Polynucleotide
cgcactcctagtgaatc

SEQ ID NO: 8290 - DNA, 17 bp, Artificial Sequence
  Synthetic Polynucleotide
ttgtgattgtgaactgc

SEQ ID NO: 8291 - DNA, 18 bp, Artificial Sequence
  Synthetic Polynucleotide
cggtgatgaactttatgg

SEQ ID NO: 8292 - DNA, 17 bp, Artificial Sequence
  Synthetic Polynucleotide
gacttctctccccgttt

SEQ ID NO: 8293 - DNA, 17 bp, Artificial Sequence
  Synthetic Polynucleotide
ggtcaagctatcatggc

SEQ ID NO: 8294 - DNA, 18 bp, Artificial Sequence
  Synthetic Polynucleotide
acctggatgacgcaacat

SEQ ID NO: 8295 - DNA, 18 bp, Artificial Sequence
  Synthetic Polynucleotide
ttgcttttggtgatacta

SEQ ID NO: 8296 - DNA, 18 bp, Artificial Sequence
  Synthetic Polynucleotide
ctaggacacgcctaagga

SEQ ID NO: 8297 - DNA, 18 bp, Artificial Sequence
  Synthetic Polynucleotide
gtttaggttggttttgga

SEQ ID NO: 8298 - DNA, 18 bp, Artificial Sequence
  Synthetic Polynucleotide
caagacactcgttagagt

SEQ ID NO: 8299 - DNA, 18 bp, Artificial Sequence
  Synthetic Polynucleotide
tcccctaatgtggatttt

SEQ ID NO: 8300 - DNA, 17 bp, Artificial Sequence
  Synthetic Polynucleotide
cctgtacgcctctggta

SEQ ID NO: 8301 - DNA, 18 bp, Artificial Sequence
  Synthetic Polynucleotide
cgatggacaagtatcgac

SEQ ID NO: 8302 - DNA, 18 bp, Artificial Sequence
  Synthetic Polynucleotide
ctggaatggtaagatgga

SEQ ID NO: 8303 - DNA, 18 bp, Artificial Sequence
  Synthetic Polynucleotide
aacgcctctgttacaatt

SEQ ID NO: 8304 - DNA, 18 bp, Artificial Sequence
  Synthetic Polynucleotide
agtcgctatggactgaat

SEQ ID NO: 8305 - DNA, 17 bp, Artificial Sequence
  Synthetic Polynucleotide
tcaaaggacaaatggta

SEQ ID NO: 8306 - DNA, 17 bp, Artificial Sequence
  Synthetic Polynucleotide
atcgatttaaccccgag

SEQ ID NO: 8307 - DNA, 17 bp, Artificial Sequence
  Synthetic Polynucleotide
tattccgaattggacag

SEQ ID NO: 8308 - DNA, 18 bp, Artificial Sequence
  Synthetic Polynucleotide
tatggtatgtctccgcaa

SEQ ID NO: 8309 - DNA, 17 bp, Artificial Sequence
  Synthetic Polynucleotide
gaagatctccgaagtcg

SEQ ID NO: 8310 - DNA, 18 bp, Artificial Sequence
  Synthetic Polynucleotide
gacactcatgtttggtac

SEQ ID NO: 8311 - DNA, 18 bp, Artificial Sequence
  Synthetic Polynucleotide
agattgctgataaaccgg

SEQ ID NO: 8312 - DNA, 18 bp, Artificial Sequence
  Synthetic Polynucleotide
acgtatattgtggtcgct

SEQ ID NO: 8313 - DNA, 17 bp, Artificial Sequence
  Synthetic Polynucleotide
tgatggacccgaatatg

SEQ ID NO: 8314 - DNA, 18 bp, Artificial Sequence
  Synthetic Polynucleotide
aattgttcctcccaaata

SEQ ID NO: 8315 - DNA, 18 bp, Artificial Sequence
  Synthetic Polynucleotide
tctcgtatatgactcctc

SEQ ID NO: 8316 - DNA, 18 bp, Artificial Sequence
  Synthetic Polynucleotide
tgttggctcttgataagt

SEQ ID NO: 8317 - DNA, 18 bp, Artificial Sequence
  Synthetic Polynucleotide
tcccagaatgaactaaga

SEQ ID NO: 8318 - DNA, 17 bp, Artificial Sequence
  Synthetic Polynucleotide
tatcccgcagatggttc

SEQ ID NO: 8319 - DNA, 17 bp, Artificial Sequence
  Synthetic Polynucleotide
taaacacttcccctcaa

SEQ ID NO: 8320 - DNA, 18 bp, Artificial Sequence
  Synthetic Polynucleotide
ttcagaaggaaacccgat

SEQ ID NO: 8321 - DNA, 17 bp, Artificial Sequence
  Synthetic Polynucleotide
accgctggtgaaatgac

SEQ ID NO: 8322 - DNA, 17 bp, Artificial Sequence
  Synthetic Polynucleotide
ttcccgttattcatgcg

SEQ ID NO: 8323 - DNA, 18 bp, Artificial Sequence
  Synthetic Polynucleotide
tccatgtctccgtaacaa

SEQ ID NO: 8324 - DNA, 17 bp, Artificial Sequence
  Synthetic Polynucleotide
ggtcaatggttgtaccc

SEQ ID NO: 8325 - DNA, 18 bp, Artificial Sequence
  Synthetic Polynucleotide
acaatggttagtagctga

SEQ ID NO: 8326 - DNA, 18 bp, Artificial Sequence
  Synthetic Polynucleotide
gaagatcctgtgcctggt

SEQ ID NO: 8327 - DNA, 18 bp, Artificial Sequence
  Synthetic Polynucleotide
ctttccgctctttcttac

SEQ ID NO: 8328 - DNA, 17 bp, Artificial Sequence
  Synthetic Polynucleotide
tggtggctgttccgaat

SEQ ID NO: 8329 - DNA, 18 bp, Artificial Sequence
  Synthetic Polynucleotide
tctataagagtacccgtc

SEQ ID NO: 8330 - DNA, 17 bp, Artificial Sequence
  Synthetic Polynucleotide
cccctggattgagttac

SEQ ID NO: 8331 - DNA, 17 bp, Artificial Sequence
  Synthetic Polynucleotide
tattcaataccccgcta

SEQ ID NO: 8332 - DNA, 18 bp, Artificial Sequence
  Synthetic Polynucleotide
cgtcgttaagtttgaaca

SEQ ID NO: 8333 - DNA, 17 bp, Artificial Sequence
  Synthetic Polynucleotide
ccgcctgatccccatgt

SEQ ID NO: 8334 - DNA, 17 bp, Artificial Sequence
  Synthetic Polynucleotide
cccctcttttaaggctc

SEQ ID NO: 8335 - DNA, 18 bp, Artificial Sequence
  Synthetic Polynucleotide
cagtcttaatgttcgctt

SEQ ID NO: 8336 - DNA, 17 bp, Artificial Sequence
  Synthetic Polynucleotide
tgattccgctctcatgc

SEQ ID NO: 8337 - DNA, 18 bp, Artificial Sequence
  Synthetic Polynucleotide
agctatggcccgttctat

SEQ ID NO: 8338 - DNA, 18 bp, Artificial Sequence
  Synthetic Polynucleotide
ttcccactcatgcttatt

SEQ ID NO: 8339 - DNA, 18 bp, Artificial Sequence
  Synthetic Polynucleotide
attcaatggtgaatccgt

SEQ ID NO: 8340 - DNA, 18 bp, Artificial Sequence
  Synthetic Polynucleotide
agcaagattatccgctaa

SEQ ID NO: 8341 - DNA, 17 bp, Artificial Sequence
  Synthetic Polynucleotide
ccctcgctatcttcctc

SEQ ID NO: 8342 - DNA, 17 bp, Artificial Sequence
  Synthetic Polynucleotide
gcccgattgtagtctgt

SEQ ID NO: 8343 - DNA, 18 bp, Artificial Sequence
  Synthetic Polynucleotide
tcgttattccgtttatga

SEQ ID NO: 8344 - DNA, 17 bp, Artificial Sequence
  Synthetic Polynucleotide
gccgaatggtatactga

SEQ ID NO: 8345 - DNA, 18 bp, Artificial Sequence
  Synthetic Polynucleotide
ccaaagtcttcttcccag

SEQ ID NO: 8346 - DNA, 17 bp, Artificial Sequence
  Synthetic Polynucleotide
gccctcattttcaagtg

SEQ ID NO: 8347 - DNA, 17 bp, Artificial Sequence
  Synthetic Polynucleotide
tagtgattcctcctcta

SEQ ID NO: 8348 - DNA, 17 bp, Artificial Sequence
  Synthetic Polynucleotide
gtctaccgtcgttatga

SEQ ID NO: 8349 - DNA, 17 bp, Artificial Sequence
  Synthetic Polynucleotide
cttaaacacgctttccg

SEQ ID NO: 8350 - DNA, 18 bp, Artificial Sequence
  Synthetic Polynucleotide
ctcccgtatccgaatttc

SEQ ID NO: 8351 - DNA, 17 bp, Artificial Sequence
  Synthetic Polynucleotide
tgtggattttccgcaac

SEQ ID NO: 8352 - DNA, 18 bp, Artificial Sequence
  Synthetic Polynucleotide
atcctgatggtaaggttc

SEQ ID NO: 8353 - DNA, 18 bp, Artificial Sequence
  Synthetic Polynucleotide
tatcccctaatcgtttga

SEQ ID NO: 8354 - DNA, 17 bp, Artificial Sequence
  Synthetic Polynucleotide
tcctcgtttatgtaccg

SEQ ID NO: 8355 - DNA, 18 bp, Artificial Sequence
  Synthetic Polynucleotide
cacttcctccccagatat

SEQ ID NO: 8356 - DNA, 17 bp, Artificial Sequence
  Synthetic Polynucleotide
catcgttggattgatgc

SEQ ID NO: 8357 - DNA, 17 bp, Artificial Sequence
  Synthetic Polynucleotide
taagatccgcctcaagg

SEQ ID NO: 8358 - DNA, 18 bp, Artificial Sequence
  Synthetic Polynucleotide
atgttcctgagttggctg

SEQ ID NO: 8359 - DNA, 17 bp, Artificial Sequence
  Synthetic Polynucleotide
aacttctcgttgtaggc

SEQ ID NO: 8360 - DNA, 17 bp, Artificial Sequence
  Synthetic Polynucleotide
tactatggctctttcga

SEQ ID NO: 8361 - DNA, 18 bp, Artificial Sequence
  Synthetic Polynucleotide
tcgaatgtacctgattgc

SEQ ID NO: 8362 - DNA, 17 bp, Artificial Sequence
  Synthetic Polynucleotide
gacgttccctctaaagg

SEQ ID NO: 8363 - DNA, 18 bp, Artificial Sequence
  Synthetic Polynucleotide
actccctctccctcgatt

SEQ ID NO: 8364 - DNA, 18 bp, Artificial Sequence
  Synthetic Polynucleotide
agattttatgcaactggc

SEQ ID NO: 8365 - DNA, 17 bp, Artificial Sequence
  Synthetic Polynucleotide
aattgaacacgcaagta

SEQ ID NO: 8366 - DNA, 18 bp, Artificial Sequence
  Synthetic Polynucleotide
gatggatatgtcacgtta

SEQ ID NO: 8367 - DNA, 17 bp, Artificial Sequence
  Synthetic Polynucleotide
gtcgtccctgtgatttg

SEQ ID NO: 8368 - DNA, 17 bp, Artificial Sequence
  Synthetic Polynucleotide
gggatggttcttagacg

SEQ ID NO: 8369 - DNA, 18 bp, Artificial Sequence
  Synthetic Polynucleotide
tccgtaatttccgataac

SEQ ID NO: 8370 - DNA, 17 bp, Artificial Sequence
  Synthetic Polynucleotide
agagtatgttcccgagt

SEQ ID NO: 8371 - DNA, 18 bp, Artificial Sequence
  Synthetic Polynucleotide
acatcaaggacatttcca

SEQ ID NO: 8372 - DNA, 18 bp, Artificial Sequence
  Synthetic Polynucleotide
tagtagtagactccttga

SEQ ID NO: 8373 - DNA, 18 bp, Artificial Sequence
  Synthetic Polynucleotide
tacctcttattgcttcag

SEQ ID NO: 8374 - DNA, 17 bp, Artificial Sequence
  Synthetic Polynucleotide
tttgcttttcagcacag

SEQ ID NO: 8375 - DNA, 17 bp, Artificial Sequence
  Synthetic Polynucleotide
acttcgcagaccccttt

SEQ ID NO: 8376 - DNA, 17 bp, Artificial Sequence
  Synthetic Polynucleotide
actacattgacgggatg

SEQ ID NO: 8377 - DNA, 17 bp, Artificial Sequence
  Synthetic Polynucleotide
ttgcaaacctgttcata

SEQ ID NO: 8378 - DNA, 17 bp, Artificial Sequence
  Synthetic Polynucleotide
atcaggaccaaaatggc

SEQ ID NO: 8379 - DNA, 17 bp, Artificial Sequence
  Synthetic Polynucleotide
ctcacccagcagttgct

SEQ ID NO: 8380 - DNA, 18 bp, Artificial Sequence
  Synthetic Polynucleotide
gtcacaaacaaccaggat

SEQ ID NO: 8381 - DNA, 17 bp, Artificial Sequence
  Synthetic Polynucleotide
acaaagctccctagaga

SEQ ID NO: 8382 - DNA, 18 bp, Artificial Sequence
  Synthetic Polynucleotide
tttcttggcatccttctc

SEQ ID NO: 8383 - DNA, 17 bp, Artificial Sequence
  Synthetic Polynucleotide
cgcacagccctttaagt

SEQ ID NO: 8384 - DNA, 17 bp, Artificial Sequence
  Synthetic Polynucleotide
cacaccaagtccattct

SEQ ID NO: 8385 - DNA, 18 bp, Artificial Sequence
  Synthetic Polynucleotide
tcctgtaggttcatcaat

SEQ ID NO: 8386 - DNA, 18 bp, Artificial Sequence
  Synthetic Polynucleotide
gtagactccctaaagagc

SEQ ID NO: 8387 - DNA, 18 bp, Artificial Sequence
  Synthetic Polynucleotide
actaccaaaagaaacccc

SEQ ID NO: 8388 - DNA, 18 bp, Artificial Sequence
  Synthetic Polynucleotide
tctgccccactataccaa

SEQ ID NO: 8389 - DNA, 18 bp, Artificial Sequence
  Synthetic Polynucleotide
tgtcccctaccacccacc

SEQ ID NO: 8390 - DNA, 18 bp, Artificial Sequence
  Synthetic Polynucleotide
acaacgatcttaccatcc

SEQ ID NO: 8391 - DNA, 17 bp, Artificial Sequence
  Synthetic Polynucleotide
ctgacacacttgtttcc

SEQ ID NO: 8392 - DNA, 18 bp, Artificial Sequence
  Synthetic Polynucleotide
tagtagactccgcaagaa

SEQ ID NO: 8393 - DNA, 17 bp, Artificial Sequence
  Synthetic Polynucleotide
gaccccaccaaaagtaa

SEQ ID NO: 8394 - DNA, 17 bp, Artificial Sequence
  Synthetic Polynucleotide
gtcttcttcctcaacca

SEQ ID NO: 8395 - DNA, 18 bp, Artificial Sequence
  Synthetic Polynucleotide
tctcttctgccttcatgc

SEQ ID NO: 8396 - DNA, 17 bp, Artificial Sequence
  Synthetic Polynucleotide
tagactccctaaagagc

SEQ ID NO: 8397 - DNA, 17 bp, Artificial Sequence
  Synthetic Polynucleotide
tttgcattgacacggaa

SEQ ID NO: 8398 - DNA, 17 bp, Artificial Sequence
  Synthetic Polynucleotide
acgtgccgcttacgccc

SEQ ID NO: 8399 - DNA, 18 bp, Artificial Sequence
  Synthetic Polynucleotide
agcacttgtctttcagtt

SEQ ID NO: 8400 - DNA, 17 bp, Artificial Sequence
  Synthetic Polynucleotide
tctggagaatccattgg

SEQ ID NO: 8401 - DNA, 17 bp, Artificial Sequence
  Synthetic Polynucleotide
tcagccttcattgttga

SEQ ID NO: 8402 - DNA, 17 bp, Artificial Sequence
  Synthetic Polynucleotide
ggctacaaaaccagttg

SEQ ID NO: 8403 - DNA, 17 bp, Artificial Sequence
  Synthetic Polynucleotide
gtgcagccacatctttc

SEQ ID NO: 8404 - DNA, 18 bp, Artificial Sequence
  Synthetic Polynucleotide
cagatgtactctcctgtc

SEQ ID NO: 8405 - DNA, 17 bp, Artificial Sequence
  Synthetic Polynucleotide
ctgctcacaaactctct

SEQ ID NO: 8406 - DNA, 17 bp, Artificial Sequence
  Synthetic Polynucleotide
cccagtccattccactg

SEQ ID NO: 8407 - DNA, 17 bp, Artificial Sequence
  Synthetic Polynucleotide
cccagcttacagcataa

SEQ ID NO: 8408 - DNA, 18 bp, Artificial Sequence
  Synthetic Polynucleotide
tgcttcaatcagcatatg

SEQ ID NO: 8409 - DNA, 17 bp, Artificial Sequence
  Synthetic Polynucleotide
tgacccaccctctgagt

SEQ ID NO: 8410 - DNA, 17 bp, Artificial Sequence
  Synthetic Polynucleotide
acaatcatggcatccaa

SEQ ID NO: 8411 - DNA, 18 bp, Artificial Sequence
  Synthetic Polynucleotide
accaaattgactcacgaa

SEQ ID NO: 8412 - DNA, 18 bp, Artificial Sequence
  Synthetic Polynucleotide
cataccattgagcctttt

SEQ ID NO: 8413 - DNA, 18 bp, Artificial Sequence
  Synthetic Polynucleotide
tcctaaagttcattgcta

SEQ ID NO: 8414 - DNA, 18 bp, Artificial Sequence
  Synthetic Polynucleotide
ggacattcccatatctga

SEQ ID NO: 8415 - DNA, 18 bp, Artificial Sequence
  Synthetic Polynucleotide
cccagatgacgttaacaa

SEQ ID NO: 8416 - DNA, 18 bp, Artificial Sequence
  Synthetic Polynucleotide
ggcattccttttccataa

SEQ ID NO: 8417 - DNA, 17 bp, Artificial Sequence
  Synthetic Polynucleotide
ggataaactcgcagact

SEQ ID NO: 8418 - DNA, 18 bp, Artificial Sequence
  Synthetic Polynucleotide
tcaactttccacttgaca

SEQ ID NO: 8419 - DNA, 17 bp, Artificial Sequence
  Synthetic Polynucleotide
tgcacatcatcaacctg

SEQ ID NO: 8420 - DNA, 18 bp, Artificial Sequence
  Synthetic Polynucleotide
gtccatagaccatcgtcg

SEQ ID NO: 8421 - DNA, 17 bp, Artificial Sequence
  Synthetic Polynucleotide
taaatttgacccctgca

SEQ ID NO: 8422 - DNA, 17 bp, Artificial Sequence
  Synthetic Polynucleotide
tcttcttcctcaaccag

SEQ ID NO: 8423 - DNA, 18 bp, Artificial Sequence
  Synthetic Polynucleotide
tcactgtaatgttccata

SEQ ID NO: 8424 - DNA, 18 bp, Artificial Sequence
  Synthetic Polynucleotide
ctaagattgcttcccacc

SEQ ID NO: 8425 - DNA, 18 bp, Artificial Sequence
  Synthetic Polynucleotide
ctgtccccaaccacccac

SEQ ID NO: 8426 - DNA, 18 bp, Artificial Sequence
  Synthetic Polynucleotide
cttaccctccacagactc

SEQ ID NO: 8427 - DNA, 17 bp, Artificial Sequence
  Synthetic Polynucleotide
tagtacctgcctcaatc

SEQ ID NO: 8428 - DNA, 18 bp, Artificial Sequence
  Synthetic Polynucleotide
gatgttacaaccagcatc

SEQ ID NO: 8429 - DNA, 17 bp, Artificial Sequence
  Synthetic Polynucleotide
tggccgattcagaactg

SEQ ID NO: 8430 - DNA, 17 bp, Artificial Sequence
  Synthetic Polynucleotide
ctgtgttcttcacacct

SEQ ID NO: 8431 - DNA, 17 bp, Artificial Sequence
  Synthetic Polynucleotide
tgcattcagcatcaacg

SEQ ID NO: 8432 - DNA, 17 bp, Artificial Sequence
  Synthetic Polynucleotide
gcctatccttcctcaag

SEQ ID NO: 8433 - DNA, 17 bp, Artificial Sequence
  Synthetic Polynucleotide
tgcacactttcccaact

SEQ ID NO: 8434 - DNA, 17 bp, Artificial Sequence
  Synthetic Polynucleotide
taacaacaccagcattg

SEQ ID NO: 8435 - DNA, 17 bp, Artificial Sequence
  Synthetic Polynucleotide
atgtaccacaacggact

SEQ ID NO: 8436 - DNA, 18 bp, Artificial Sequence
  Synthetic Polynucleotide
ggacattcccatatctca

SEQ ID NO: 8437 - DNA, 18 bp, Artificial Sequence
  Synthetic Polynucleotide
ggctacaaaaccagttga

SEQ ID NO: 8438 - DNA, 17 bp, Artificial Sequence
  Synthetic Polynucleotide
accccaaccagtctcat

SEQ ID NO: 8439 - DNA, 18 bp, Artificial Sequence
  Synthetic Polynucleotide
cagctacaaaacccagca

SEQ ID NO: 8440 - DNA, 17 bp, Artificial Sequence
  Synthetic Polynucleotide
agtagtagactccgcaa

SEQ ID NO: 8441 - DNA, 17 bp, Artificial Sequence
  Synthetic Polynucleotide
tcacactcacatgttta

SEQ ID NO: 8442 - DNA, 18 bp, Artificial Sequence
  Synthetic Polynucleotide
ccaccttacctgttacac

SEQ ID NO: 8443 - DNA, 17 bp, Artificial Sequence
  Synthetic Polynucleotide
aattcttcacaacccca

SEQ ID NO: 8444 - DNA, 17 bp, Artificial Sequence
  Synthetic Polynucleotide
atctagcataccagcct

SEQ ID NO: 8445 - DNA, 17 bp, Artificial Sequence
  Synthetic Polynucleotide
acccacccacaacggat

SEQ ID NO: 8446 - DNA, 18 bp, Artificial Sequence
  Synthetic Polynucleotide
gtcaccatcatcaatctg

SEQ ID NO: 8447 - DNA, 17 bp, Artificial Sequence
  Synthetic Polynucleotide
tgcatttcctctcacct

SEQ ID NO: 8448 - DNA, 18 bp, Artificial Sequence
  Synthetic Polynucleotide
agcacaaatagacactcc

SEQ ID NO: 8449 - DNA, 17 bp, Artificial Sequence
  Synthetic Polynucleotide
gcttagcagcatcattc

SEQ ID NO: 8450 - DNA, 18 bp, Artificial Sequence
  Synthetic Polynucleotide
gctacaaatactgacgta

SEQ ID NO: 8451 - DNA, 17 bp, Artificial Sequence
  Synthetic Polynucleotide
tcaacttcagcagacac

SEQ ID NO: 8452 - DNA, 18 bp, Artificial Sequence
  Synthetic Polynucleotide
gtagactccgcaaaagaa

SEQ ID NO: 8453 - DNA, 18 bp, Artificial Sequence
  Synthetic Polynucleotide
ttgctttacaccatctcc

SEQ ID NO: 8454 - DNA, 18 bp, Artificial Sequence
  Synthetic Polynucleotide
agcctcataaagaagtcc

SEQ ID NO: 8455 - DNA, 17 bp, Artificial Sequence
  Synthetic Polynucleotide
ccgaccacactgttttc

SEQ ID NO: 8456 - DNA, 17 bp, Artificial Sequence
  Synthetic Polynucleotide
tagtagacaccgcaaga

SEQ ID NO: 8457 - DNA, 17 bp, Artificial Sequence
  Synthetic Polynucleotide
gtccccaaccacccacc

SEQ ID NO: 8458 - DNA, 17 bp, Artificial Sequence
  Synthetic Polynucleotide
ccctccaccgcctcagt

SEQ ID NO: 8459 - DNA, 18 bp, Artificial Sequence
  Synthetic Polynucleotide
tcgtaaactcttgtaccc

SEQ ID NO: 8460 - DNA, 18 bp, Artificial Sequence
  Synthetic Polynucleotide
ggtttagcataccatcca

SEQ ID NO: 8461 - DNA, 17 bp, Artificial Sequence
  Synthetic Polynucleotide
actgcctcctttcccca

SEQ ID NO: 8462 - DNA, 17 bp, Artificial Sequence
  Synthetic Polynucleotide
ggaatttcaagccctca

SEQ ID NO: 8463 - DNA, 18 bp, Artificial Sequence
  Synthetic Polynucleotide
gttttctggcatcagttc

SEQ ID NO: 8464 - DNA, 18 bp, Artificial Sequence
  Synthetic Polynucleotide
tagttgcatcacctaaaa

SEQ ID NO: 8465 - DNA, 17 bp, Artificial Sequence
  Synthetic Polynucleotide
acccaacccaaccccta

SEQ ID NO: 8466 - DNA, 17 bp, Artificial Sequence
  Synthetic Polynucleotide
atgccctcctacctgcc

SEQ ID NO: 8467 - DNA, 17 bp, Artificial Sequence
  Synthetic Polynucleotide
cctatcatacagctccg

SEQ ID NO: 8468 - DNA, 17 bp, Artificial Sequence
  Synthetic Polynucleotide
tttgcatcttcctcgtg

SEQ ID NO: 8469 - DNA, 17 bp, Artificial Sequence
  Synthetic Polynucleotide
ccccaaccagtctcata

SEQ ID NO: 8470 - DNA, 18 bp, Artificial Sequence
  Synthetic Polynucleotide
ctccctaccatcctctgc

SEQ ID NO: 8471 - DNA, 18 bp, Artificial Sequence
  Synthetic Polynucleotide
tgtgatctcttcagcctt

SEQ ID NO: 8472 - DNA, 17 bp, Artificial Sequence
  Synthetic Polynucleotide
tgaccacctcaaagaga

SEQ ID NO: 8473 - DNA, 17 bp, Artificial Sequence
  Synthetic Polynucleotide
tctttgcccattctacc

SEQ ID NO: 8474 - DNA, 18 bp, Artificial Sequence
  Synthetic Polynucleotide
tccttcatttcccatgtc

SEQ ID NO: 8475 - DNA, 17 bp, Artificial Sequence
  Synthetic Polynucleotide
gtcagaccaatcatgct

SEQ ID NO: 8476 - DNA, 18 bp, Artificial Sequence
  Synthetic Polynucleotide
gactccgagatagagaag

SEQ ID NO: 8477 - DNA, 17 bp, Artificial Sequence
  Synthetic Polynucleotide
tctggcattaacactct

SEQ ID NO: 8478 - DNA, 17 bp, Artificial Sequence
  Synthetic Polynucleotide
gcacctcatcactaggc

SEQ ID NO: 8479 - DNA, 18 bp, Artificial Sequence
  Synthetic Polynucleotide
gtcgaccatcatatccat

SEQ ID NO: 8480 - DNA, 18 bp, Artificial Sequence
  Synthetic Polynucleotide
cttcaagacacaaccact

SEQ ID NO: 8481 - DNA, 17 bp, Artificial Sequence
  Synthetic Polynucleotide
tcaactattcccctctc

SEQ ID NO: 8482 - DNA, 18 bp, Artificial Sequence
  Synthetic Polynucleotide
aaaatttcactcgcctca

SEQ ID NO: 8483 - DNA, 17 bp, Artificial Sequence
  Synthetic Polynucleotide
ccatatcatcacccagg

SEQ ID NO: 8484 - DNA, 18 bp, Artificial Sequence
  Synthetic Polynucleotide
ttctcatcaaaccctgcc

SEQ ID NO: 8485 - DNA, 18 bp, Artificial Sequence
  Synthetic Polynucleotide
gttgacatccattccatc

SEQ ID NO: 8486 - DNA, 17 bp, Artificial Sequence
  Synthetic Polynucleotide
tctcgctacgtttaacc

SEQ ID NO: 8487 - DNA, 17 bp, Artificial Sequence
  Synthetic Polynucleotide
tccttcctccacttgag

SEQ ID NO: 8488 - DNA, 17 bp, Artificial Sequence
  Synthetic Polynucleotide
cgtgccgcttacgccca

SEQ ID NO: 8489 - DNA, 17 bp, Artificial Sequence
  Synthetic Polynucleotide
ctgactctaaccagcaa

SEQ ID NO: 8490 - DNA, 17 bp, Artificial Sequence
  Synthetic Polynucleotide
tacccagcacaatcatg

SEQ ID NO: 8491 - DNA, 18 bp, Artificial Sequence
  Synthetic Polynucleotide
ggcttaccccattcaaaa

SEQ ID NO: 8492 - DNA, 17 bp, Artificial Sequence
  Synthetic Polynucleotide
gcctcctattgatccag

SEQ ID NO: 8493 - DNA, 18 bp, Artificial Sequence
  Synthetic Polynucleotide
tgcttttccacatttcag

SEQ ID NO: 8494 - DNA, 17 bp, Artificial Sequence
  Synthetic Polynucleotide
tttgctcaccattcaga

SEQ ID NO: 8495 - DNA, 17 bp, Artificial Sequence
  Synthetic Polynucleotide
atccctcaccttctgcc

SEQ ID NO: 8496 - DNA, 17 bp, Artificial Sequence
  Synthetic Polynucleotide
gcagacaaccaaagata

SEQ ID NO: 8497 - DNA, 18 bp, Artificial Sequence
  Synthetic Polynucleotide
actgcctctcttgactag

SEQ ID NO: 8498 - DNA, 18 bp, Artificial Sequence
  Synthetic Polynucleotide
tcaactttcaaaccaaca

SEQ ID NO: 8499 - DNA, 18 bp, Artificial Sequence
  Synthetic Polynucleotide
tgcagctccttattgaca

SEQ ID NO: 8500 - DNA, 18 bp, Artificial Sequence
  Synthetic Polynucleotide
tcaatcctttccatccag

SEQ ID NO: 8501 - DNA, 18 bp, Artificial Sequence
  Synthetic Polynucleotide
gccaacagcacaatcaac

SEQ ID NO: 8502 - DNA, 18 bp, Artificial Sequence
  Synthetic Polynucleotide
catcagcactcacataca

SEQ ID NO: 8503 - DNA, 18 bp, Artificial Sequence
  Synthetic Polynucleotide
cacagactaatccaaacg

SEQ ID NO: 8504 - DNA, 18 bp, Artificial Sequence
  Synthetic Polynucleotide
tctttcaccttagcatca

SEQ ID NO: 8505 - DNA, 18 bp, Artificial Sequence
  Synthetic Polynucleotide
gagaaacactatcatggc

SEQ ID NO: 8506 - DNA, 17 bp, Artificial Sequence
  Synthetic Polynucleotide
gtcttctagactctgcc

SEQ ID NO: 8507 - DNA, 17 bp, Artificial Sequence
  Synthetic Polynucleotide
gcagtcacttttcccaa

SEQ ID NO: 8508 - DNA, 17 bp, Artificial Sequence
  Synthetic Polynucleotide
atgtcacccattcacca

SEQ ID NO: 8509 - DNA, 18 bp, Artificial Sequence
  Synthetic Polynucleotide
gtattcacccctaagagc

SEQ ID NO: 8510 - DNA, 18 bp, Artificial Sequence
  Synthetic Polynucleotide
cagttgaattcccattga

SEQ ID NO: 8511 - DNA, 17 bp, Artificial Sequence
  Synthetic Polynucleotide
ggtgcccattcctacct

SEQ ID NO: 8512 - DNA, 18 bp, Artificial Sequence
  Synthetic Polynucleotide
caattgcattcacatcga

SEQ ID NO: 8513 - DNA, 17 bp, Artificial Sequence
  Synthetic Polynucleotide
aactcgcagactacaag

SEQ ID NO: 8514 - DNA, 18 bp, Artificial Sequence
  Synthetic Polynucleotide
accataccaaacccacat

SEQ ID NO: 8515 - DNA, 18 bp, Artificial Sequence
  Synthetic Polynucleotide
gcaagcccattattccat

SEQ ID NO: 8516 - DNA, 17 bp, Artificial Sequence
  Synthetic Polynucleotide
gtgcatcatccattgta

SEQ ID NO: 8517 - DNA, 18 bp, Artificial Sequence
  Synthetic Polynucleotide
tcaagctcacaaaagaaa

SEQ ID NO: 8518 - DNA, 18 bp, Artificial Sequence
  Synthetic Polynucleotide
ttttgaccccttactaga

SEQ ID NO: 8519 - DNA, 17 bp, Artificial Sequence
  Synthetic Polynucleotide
gcatcatttctcacgtc

SEQ ID NO: 8520 - DNA, 18 bp, Artificial Sequence
  Synthetic Polynucleotide
aaattctgtttcccagca

SEQ ID NO: 8521 - DNA, 17 bp, Artificial Sequence
  Synthetic Polynucleotide
gcttgtcaccaaagtca

SEQ ID NO: 8522 - DNA, 17 bp, Artificial Sequence
  Synthetic Polynucleotide
tcacatccaatccacag

SEQ ID NO: 8523 - DNA, 18 bp, Artificial Sequence
  Synthetic Polynucleotide
gccaatatagcacttagc

SEQ ID NO: 8524 - DNA, 17 bp, Artificial Sequence
  Synthetic Polynucleotide
ccgcctccttccatagg

SEQ ID NO: 8525 - DNA, 18 bp, Artificial Sequence
  Synthetic Polynucleotide
aaactcacaaaccctgtg

SEQ ID NO: 8526 - DNA, 18 bp, Artificial Sequence
  Synthetic Polynucleotide
cgatcttaccatccacag

SEQ ID NO: 8527 - DNA, 17 bp, Artificial Sequence
  Synthetic Polynucleotide
cgcattcctcacaatac

SEQ ID NO: 8528 - DNA, 17 bp, Artificial Sequence
  Synthetic Polynucleotide
tatcacccattcacaga

SEQ ID NO: 8529 - DNA, 18 bp, Artificial Sequence
  Synthetic Polynucleotide
aattcttcacaaccccat

SEQ ID NO: 8530 - DNA, 18 bp, Artificial Sequence
  Synthetic Polynucleotide
tacaatacgctacccaat

SEQ ID NO: 8531 - DNA, 17 bp, Artificial Sequence
  Synthetic Polynucleotide
acccacccaacccaatc

SEQ ID NO: 8532 - DNA, 17 bp, Artificial Sequence
  Synthetic Polynucleotide
gcacaaagtctcattga

SEQ ID NO: 8533 - DNA, 18 bp, Artificial Sequence
  Synthetic Polynucleotide
gattgcctctcatcctct

SEQ ID NO: 8534 - DNA, 18 bp, Artificial Sequence
  Synthetic Polynucleotide
gcacccaaattcttcgca

SEQ ID NO: 8535 - DNA, 17 bp, Artificial Sequence
  Synthetic Polynucleotide
acaggccccactatagg

SEQ ID NO: 8536 - DNA, 17 bp, Artificial Sequence
  Synthetic Polynucleotide
gccgcacagccctttat

SEQ ID NO: 8537 - DNA, 17 bp, Artificial Sequence
  Synthetic Polynucleotide
cgaatcctcattccctt

SEQ ID NO: 8538 - DNA, 17 bp, Artificial Sequence
  Synthetic Polynucleotide
tgatctcaaccaccttg

SEQ ID NO: 8539 - DNA, 17 bp, Artificial Sequence
  Synthetic Polynucleotide
acagcacaaccttcaaa

SEQ ID NO: 8540 - DNA, 18 bp, Artificial Sequence
  Synthetic Polynucleotide
aaaatcatgaccctcaca

SEQ ID NO: 8541 - DNA, 17 bp, Artificial Sequence
  Synthetic Polynucleotide
gtcacctgccctaaagg

SEQ ID NO: 8542 - DNA, 18 bp, Artificial Sequence
  Synthetic Polynucleotide
tagtagtagactccgcac

SEQ ID NO: 8543 - DNA, 17 bp, Artificial Sequence
  Synthetic Polynucleotide
cctttcacttcagcaag

SEQ ID NO: 8544 - DNA, 18 bp, Artificial Sequence
  Synthetic Polynucleotide
tcttcttcctcaatcaga

SEQ ID NO: 8545 - DNA, 17 bp, Artificial Sequence
  Synthetic Polynucleotide
cctttcacctcagcaag

SEQ ID NO: 8546 - DNA, 18 bp, Artificial Sequence
  Synthetic Polynucleotide
ctaaacccacccacaacg

SEQ ID NO: 8547 - DNA, 18 bp, Artificial Sequence
  Synthetic Polynucleotide
agtcaccatcatccatct

SEQ ID NO: 8548 - DNA, 18 bp, Artificial Sequence
  Synthetic Polynucleotide
gcacacataattccacag

SEQ ID NO: 8549 - DNA, 18 bp, Artificial Sequence
  Synthetic Polynucleotide
gcaaaagtccctcatagt

SEQ ID NO: 8550 - DNA, 17 bp, Artificial Sequence
  Synthetic Polynucleotide
tgtgacccattcacctt

SEQ ID NO: 8551 - DNA, 17 bp, Artificial Sequence
  Synthetic Polynucleotide
tccaacagcattcctta

SEQ ID NO: 8552 - DNA, 18 bp, Artificial Sequence
  Synthetic Polynucleotide
cagacagatctcccatac

SEQ ID NO: 8553 - DNA, 18 bp, Artificial Sequence
  Synthetic Polynucleotide
gcaaaatcccctaaatcg

SEQ ID NO: 8554 - DNA, 17 bp, Artificial Sequence
  Synthetic Polynucleotide
ttcacactcatgacgtt

SEQ ID NO: 8555 - DNA, 17 bp, Artificial Sequence
  Synthetic Polynucleotide
cactaagacccaacctc

SEQ ID NO: 8556 - DNA, 18 bp, Artificial Sequence
  Synthetic Polynucleotide
caagtatcgcccattatc

SEQ ID NO: 8557 - DNA, 17 bp, Artificial Sequence
  Synthetic Polynucleotide
tccttcacagcagctat

SEQ ID NO: 8558 - DNA, 18 bp, Artificial Sequence
  Synthetic Polynucleotide
ccttactcaaacctctca

SEQ ID NO: 8559 - DNA, 18 bp, Artificial Sequence
  Synthetic Polynucleotide
tatccagcagttatccta

SEQ ID NO: 8560 - DNA, 17 bp, Artificial Sequence
  Synthetic Polynucleotide
aatcacactcatgacgg

SEQ ID NO: 8561 - DNA, 18 bp, Artificial Sequence
  Synthetic Polynucleotide
tcgaaaaccaaaacatct

SEQ ID NO: 8562 - DNA, 18 bp, Artificial Sequence
  Synthetic Polynucleotide
tagccttttcaaatctcc

SEQ ID NO: 8563 - DNA, 18 bp, Artificial Sequence
  Synthetic Polynucleotide
tattttcaaccacccttc

SEQ ID NO: 8564 - DNA, 18 bp, Artificial Sequence
  Synthetic Polynucleotide
ccaagttcctttcatcta

SEQ ID NO: 8565 - DNA, 18 bp, Artificial Sequence
  Synthetic Polynucleotide
gttcagtcacttagcata

SEQ ID NO: 8566 - DNA, 18 bp, Artificial Sequence
  Synthetic Polynucleotide
tgcccattaccaaataga

SEQ ID NO: 8567 - DNA, 17 bp, Artificial Sequence
  Synthetic Polynucleotide
ttgttcccacttcaaga

SEQ ID NO: 8568 - DNA, 18 bp, Artificial Sequence
  Synthetic Polynucleotide
aacatgcttttccacatt

SEQ ID NO: 8569 - DNA, 18 bp, Artificial Sequence
  Synthetic Polynucleotide
tttgcccatcattcagat

SEQ ID NO: 8570 - DNA, 18 bp, Artificial Sequence
  Synthetic Polynucleotide
tcaccatatgactaccta

SEQ ID NO: 8571 - DNA, 18 bp, Artificial Sequence
  Synthetic Polynucleotide
tggacccaaaatttctgg

SEQ ID NO: 8572 - DNA, 18 bp, Artificial Sequence
  Synthetic Polynucleotide
aaatccacagtccctatt

SEQ ID NO: 8573 - DNA, 18 bp, Artificial Sequence
  Synthetic Polynucleotide
ttccatcatactcacaga

SEQ ID NO: 8574 - DNA, 18 bp, Artificial Sequence
  Synthetic Polynucleotide
aaccctctgatacattgc

SEQ ID NO: 8575 - DNA, 18 bp, Artificial Sequence
  Synthetic Polynucleotide
aagcccaagcctaccatg

SEQ ID NO: 8576 - DNA, 18 bp, Artificial Sequence
  Synthetic Polynucleotide
gtacaaacccctttcaga

SEQ ID NO: 8577 - DNA, 18 bp, Artificial Sequence
  Synthetic Polynucleotide
tcacacctgccttccaaa

SEQ ID NO: 8578 - DNA, 17 bp, Artificial Sequence
  Synthetic Polynucleotide
ttgaccaaatacctgca

SEQ ID NO: 8579 - DNA, 18 bp, Artificial Sequence
  Synthetic Polynucleotide
tactcacaaactctcttg

SEQ ID NO: 8580 - DNA, 17 bp, Artificial Sequence
  Synthetic Polynucleotide
tcggaccctatacatcc

SEQ ID NO: 8581 - DNA, 17 bp, Artificial Sequence
  Synthetic Polynucleotide
ccagtccattccactgc

SEQ ID NO: 8582 - DNA, 17 bp, Artificial Sequence
  Synthetic Polynucleotide
aatccaatcacacccat

SEQ ID NO: 8583 - DNA, 18 bp, Artificial Sequence
  Synthetic Polynucleotide
ttgccctaccgataattc

SEQ ID NO: 8584 - DNA, 17 bp, Artificial Sequence
  Synthetic Polynucleotide
tccttcctcctcaacag

SEQ ID NO: 8585 - DNA, 18 bp, Artificial Sequence
  Synthetic Polynucleotide
tagacacaaaccatcata

SEQ ID NO: 8586 - DNA, 17 bp, Artificial Sequence
  Synthetic Polynucleotide
tctcctgcctcatccat

SEQ ID NO: 8587 - DNA, 17 bp, Artificial Sequence
  Synthetic Polynucleotide
ttaacaccgctcgaatt

SEQ ID NO: 8588 - DNA, 18 bp, Artificial Sequence
  Synthetic Polynucleotide
ccccaataaccactcacc

SEQ ID NO: 8589 - DNA, 17 bp, Artificial Sequence
  Synthetic Polynucleotide
ggttctagcacagctaa

SEQ ID NO: 8590 - DNA, 17 bp, Artificial Sequence
  Synthetic Polynucleotide
tcaacatcagcaagtca

SEQ ID NO: 8591 - DNA, 17 bp, Artificial Sequence
  Synthetic Polynucleotide
ctcatctctcacatccg

SEQ ID NO: 8592 - DNA, 18 bp, Artificial Sequence
  Synthetic Polynucleotide
gaggacataaacccctat

SEQ ID NO: 8593 - DNA, 17 bp, Artificial Sequence
  Synthetic Polynucleotide
gcaacctcaaagaagta

SEQ ID NO: 8594 - DNA, 18 bp, Artificial Sequence
  Synthetic Polynucleotide
cttatcatacagctccga

SEQ ID NO: 8595 - DNA, 17 bp, Artificial Sequence
  Synthetic Polynucleotide
tttgccttcctcttgtt

SEQ ID NO: 8596 - DNA, 18 bp, Artificial Sequence
  Synthetic Polynucleotide
agtttcagcatccatcca

SEQ ID NO: 8597 - DNA, 17 bp, Artificial Sequence
  Synthetic Polynucleotide
gctactcactctcccat

SEQ ID NO: 8598 - DNA, 18 bp, Artificial Sequence
  Synthetic Polynucleotide
cttcacaaccccaccaag

SEQ ID NO: 8599 - DNA, 17 bp, Artificial Sequence
  Synthetic Polynucleotide
atgcagccacactctcc

SEQ ID NO: 8600 - DNA, 18 bp, Artificial Sequence
  Synthetic Polynucleotide
tattacaacactcccaac

SEQ ID NO: 8601 - DNA, 17 bp, Artificial Sequence
  Synthetic Polynucleotide
ctctcagcccaatcctt

SEQ ID NO: 8602 - DNA, 17 bp, Artificial Sequence
  Synthetic Polynucleotide
ttccagcacagatcaaa

SEQ ID NO: 8603 - DNA, 17 bp, Artificial Sequence
  Synthetic Polynucleotide
ccatcattacgccgact

SEQ ID NO: 8604 - DNA, 18 bp, Artificial Sequence
  Synthetic Polynucleotide
tccctaatcatccaacag

SEQ ID NO: 8605 - DNA, 17 bp, Artificial Sequence
  Synthetic Polynucleotide
gcccttaaacccaccct

SEQ ID NO: 8606 - DNA, 17 bp, Artificial Sequence
  Synthetic Polynucleotide
aagagccactcaaactg

SEQ ID NO: 8607 - DNA, 17 bp, Artificial Sequence
  Synthetic Polynucleotide
cccttaaacccacccta

SEQ ID NO: 8608 - DNA, 18 bp, Artificial Sequence
  Synthetic Polynucleotide
gccactatattcgcagat

SEQ ID NO: 8609 - DNA, 17 bp, Artificial Sequence
  Synthetic Polynucleotide
aacatttctgccccagg

SEQ ID NO: 8610 - DNA, 17 bp, Artificial Sequence
  Synthetic Polynucleotide
acctcattcaagcagca

SEQ ID NO: 8611 - DNA, 18 bp, Artificial Sequence
  Synthetic Polynucleotide
taccacactctgtaattg

SEQ ID NO: 8612 - DNA, 18 bp, Artificial Sequence
  Synthetic Polynucleotide
gtccatacaattccatgc

SEQ ID NO: 8613 - DNA, 17 bp, Artificial Sequence
  Synthetic Polynucleotide
acagcctgttccaactc

SEQ ID NO: 8614 - DNA, 18 bp, Artificial Sequence
  Synthetic Polynucleotide
ttccaagcccactataaa

SEQ ID NO: 8615 - DNA, 18 bp, Artificial Sequence
  Synthetic Polynucleotide
catttccctcagcatcta

SEQ ID NO: 8616 - DNA, 18 bp, Artificial Sequence
  Synthetic Polynucleotide
aacactgttccaaccaat

SEQ ID NO: 8617 - DNA, 17 bp, Artificial Sequence
  Synthetic Polynucleotide
ctccctctcattgcttc

SEQ ID NO: 8618 - DNA, 18 bp, Artificial Sequence
  Synthetic Polynucleotide
tgcatcatattgctttcc

SEQ ID NO: 8619 - DNA, 18 bp, Artificial Sequence
  Synthetic Polynucleotide
agactccttatccactga

SEQ ID NO: 8620 - DNA, 17 bp, Artificial Sequence
  Synthetic Polynucleotide
cccctaccacccaccca

SEQ ID NO: 8621 - DNA, 18 bp, Artificial Sequence
  Synthetic Polynucleotide
tatctctccttcttccca

SEQ ID NO: 8622 - DNA, 18 bp, Artificial Sequence
  Synthetic Polynucleotide
tctaaactaccccatcaa

SEQ ID NO: 8623 - DNA, 18 bp, Artificial Sequence
  Synthetic Polynucleotide
ttgcacacctgttcataa

SEQ ID NO: 8624 - DNA, 18 bp, Artificial Sequence
  Synthetic Polynucleotide
gcaccagttatattccct

SEQ ID NO: 8625 - DNA, 18 bp, Artificial Sequence
  Synthetic Polynucleotide
aactattcccctctctcc

SEQ ID NO: 8626 - DNA, 18 bp, Artificial Sequence
  Synthetic Polynucleotide
aaaatttcactcgcctca

SEQ ID NO: 8627 - DNA, 18 bp, Artificial Sequence
  Synthetic Polynucleotide
tcatctctcatccattgt

SEQ ID NO: 8628 - DNA, 18 bp, Artificial Sequence
  Synthetic Polynucleotide
gctcgaattttcttcctc

SEQ ID NO: 8629 - DNA, 17 bp, Artificial Sequence
  Synthetic Polynucleotide
atgcatttcagcatcta

SEQ ID NO: 8630 - DNA, 18 bp, Artificial Sequence
  Synthetic Polynucleotide
caccctaaaacaaccatg

SEQ ID NO: 8631 - DNA, 18 bp, Artificial Sequence
  Synthetic Polynucleotide
tgcccaaatattccattg

SEQ ID NO: 8632 - DNA, 18 bp, Artificial Sequence
  Synthetic Polynucleotide
gctcagtttcacagtact

SEQ ID NO: 8633 - DNA, 18 bp, Artificial Sequence
  Synthetic Polynucleotide
gttaaccacttccacctg

SEQ ID NO: 8634 - DNA, 17 bp, Artificial Sequence
  Synthetic Polynucleotide
gcaccgattattttccc

SEQ ID NO: 8635 - DNA, 18 bp, Artificial Sequence
  Synthetic Polynucleotide
tcaccataatcatccaca

SEQ ID NO: 8636 - DNA, 17 bp, Artificial Sequence
  Synthetic Polynucleotide
tcaaaccacctgttcat

SEQ ID NO: 8637 - DNA, 18 bp, Artificial Sequence
  Synthetic Polynucleotide
gtgccgcttacgcccaca

SEQ ID NO: 8638 - DNA, 18 bp, Artificial Sequence
  Synthetic Polynucleotide
actctctcccactaccat

SEQ ID NO: 8639 - DNA, 18 bp, Artificial Sequence
  Synthetic Polynucleotide
gcacctttcatctttctc

SEQ ID NO: 8640 - DNA, 17 bp, Artificial Sequence
  Synthetic Polynucleotide
ccgggatatcgctacca

SEQ ID NO: 8641 - DNA, 18 bp, Artificial Sequence
  Synthetic Polynucleotide
tcagacgtttccatagta

SEQ ID NO: 8642 - DNA, 18 bp, Artificial Sequence
  Synthetic Polynucleotide
tcacattagacgtttcca

SEQ ID NO: 8643 - DNA, 17 bp, Artificial Sequence
  Synthetic Polynucleotide
aaccccttccactagct

SEQ ID NO: 8644 - DNA, 17 bp, Artificial Sequence
  Synthetic Polynucleotide
tagtagtagactccgca

SEQ ID NO: 8645 - DNA, 17 bp, Artificial Sequence
  Synthetic Polynucleotide
cacaatcctcgaaacca

SEQ ID NO: 8646 - DNA, 18 bp, Artificial Sequence
  Synthetic Polynucleotide
actaaccaccacctttcg

SEQ ID NO: 8647 - DNA, 18 bp, Artificial Sequence
  Synthetic Polynucleotide
tcattgacatcacctgtt

SEQ ID NO: 8648 - DNA, 17 bp, Artificial Sequence
  Synthetic Polynucleotide
ggcttactcactccctc

SEQ ID NO: 8649 - DNA, 18 bp, Artificial Sequence
  Synthetic Polynucleotide
acaattcccacagtcgtt

SEQ ID NO: 8650 - DNA, 17 bp, Artificial Sequence
  Synthetic Polynucleotide
caatttccccatccacg

SEQ ID NO: 8651 - DNA, 18 bp, Artificial Sequence
  Synthetic Polynucleotide
ccctttaaaatcacctgc

SEQ ID NO: 8652 - DNA, 17 bp, Artificial Sequence
  Synthetic Polynucleotide
tcattgaccaaacgcaa

SEQ ID NO: 8653 - DNA, 17 bp, Artificial Sequence
  Synthetic Polynucleotide
ccgcacagccccaaatt

SEQ ID NO: 8654 - DNA, 17 bp, Artificial Sequence
  Synthetic Polynucleotide
cgcccttccaaaacgcc

SEQ ID NO: 8655 - DNA, 18 bp, Artificial Sequence
  Synthetic Polynucleotide
gcatcagctcccaattcg

SEQ ID NO: 8656 - DNA, 17 bp, Artificial Sequence
  Synthetic Polynucleotide
acgcttccttaacctta

SEQ ID NO: 8657 - DNA, 18 bp, Artificial Sequence
  Synthetic Polynucleotide
cctcattttccacaacct

SEQ ID NO: 8658 - DNA, 18 bp, Artificial Sequence
  Synthetic Polynucleotide
gtgccctcattcagtaaa

SEQ ID NO: 8659 - DNA, 18 bp, Artificial Sequence
  Synthetic Polynucleotide
agttccatccttagcatt

SEQ ID NO: 8660 - DNA, 17 bp, Artificial Sequence
  Synthetic Polynucleotide
accccttacacaccagc

SEQ ID NO: 8661 - DNA, 18 bp, Artificial Sequence
  Synthetic Polynucleotide
gttcacaatccacagcac

SEQ ID NO: 8662 - DNA, 18 bp, Artificial Sequence
  Synthetic Polynucleotide
actgaccacaaccactcc

SEQ ID NO: 8663 - DNA, 17 bp, Artificial Sequence
  Synthetic Polynucleotide
atttcacctttgcccac

SEQ ID NO: 8664 - DNA, 18 bp, Artificial Sequence
  Synthetic Polynucleotide
ttctgtaccaacttccag

SEQ ID NO: 8665 - DNA, 18 bp, Artificial Sequence
  Synthetic Polynucleotide
cctacacttatcaacgca

SEQ ID NO: 8666 - DNA, 18 bp, Artificial Sequence
  Synthetic Polynucleotide
tacaagcacatttatccg

SEQ ID NO: 8667 - DNA, 18 bp, Artificial Sequence
  Synthetic Polynucleotide
caagaccactgacatcaa

SEQ ID NO: 8668 - DNA, 18 bp, Artificial Sequence
  Synthetic Polynucleotide
ggcatcgtccattccctc

SEQ ID NO: 8669 - DNA, 18 bp, Artificial Sequence
  Synthetic Polynucleotide
acactccttcagattcag

SEQ ID NO: 8670 - DNA, 17 bp, Artificial Sequence
  Synthetic Polynucleotide
gcagacacaaactaggc

SEQ ID NO: 8671 - DNA, 17 bp, Artificial Sequence
  Synthetic Polynucleotide
gcagtccatcctttcac

SEQ ID NO: 8672 - DNA, 18 bp, Artificial Sequence
  Synthetic Polynucleotide
agcttccctttctattcc

SEQ ID NO: 8673 - DNA, 18 bp, Artificial Sequence
  Synthetic Polynucleotide
caaacccatgttccacat

SEQ ID NO: 8674 - DNA, 18 bp, Artificial Sequence
  Synthetic Polynucleotide
gcttcactcttatcatgc

SEQ ID NO: 8675 - DNA, 18 bp, Artificial Sequence
  Synthetic Polynucleotide
acaccctaaaccaagctc

SEQ ID NO: 8676 - DNA, 18 bp, Artificial Sequence
  Synthetic Polynucleotide
accacccagttttatgat

SEQ ID NO: 8677 - DNA, 18 bp, Artificial Sequence
  Synthetic Polynucleotide
tagataccctatcagtcc

SEQ ID NO: 8678 - DNA, 18 bp, Artificial Sequence
  Synthetic Polynucleotide
tcgctcagcatttactct

SEQ ID NO: 8679 - DNA, 17 bp, Artificial Sequence
  Synthetic Polynucleotide
tgcatccatccaccagc

SEQ ID NO: 8680 - DNA, 17 bp, Artificial Sequence
  Synthetic Polynucleotide
tgcttcctttccccaat

SEQ ID NO: 8681 - DNA, 17 bp, Artificial Sequence
  Synthetic Polynucleotide
caaccattcgcacatac

SEQ ID NO: 8682 - DNA, 18 bp, Artificial Sequence
  Synthetic Polynucleotide
atgacctcagcatcctca

SEQ ID NO: 8683 - DNA, 18 bp, Artificial Sequence
  Synthetic Polynucleotide
gcctcaaacaaccattca

SEQ ID NO: 8684 - DNA, 17 bp, Artificial Sequence
  Synthetic Polynucleotide
ggacaccatcactctgt

SEQ ID NO: 8685 - DNA, 18 bp, Artificial Sequence
  Synthetic Polynucleotide
ttctcagcactcctcact

SEQ ID NO: 8686 - DNA, 17 bp, Artificial Sequence
  Synthetic Polynucleotide
tccgacagcttcaaatg

SEQ ID NO: 8687 - DNA, 18 bp, Artificial Sequence
  Synthetic Polynucleotide
ggaccaccattctacttg

SEQ ID NO: 8688 - DNA, 18 bp, Artificial Sequence
  Synthetic Polynucleotide
tcagctaccattaaaccc

SEQ ID NO: 8689 - DNA, 18 bp, Artificial Sequence
  Synthetic Polynucleotide
tactttatcaccttctgc

SEQ ID NO: 8690 - DNA, 17 bp, Artificial Sequence
  Synthetic Polynucleotide
ctcttgttccccaacat

SEQ ID NO: 8691 - DNA, 17 bp, Artificial Sequence
  Synthetic Polynucleotide
cggaccaattccaaaag

SEQ ID NO: 8692 - DNA, 17 bp, Artificial Sequence
  Synthetic Polynucleotide
gcatcttcatattgccc

SEQ ID NO: 8693 - DNA, 18 bp, Artificial Sequence
  Synthetic Polynucleotide
taccatccattcacagaa

SEQ ID NO: 8694 - DNA, 18 bp, Artificial Sequence
  Synthetic Polynucleotide
tctcagtcccctctacgg

SEQ ID NO: 8695 - DNA, 18 bp, Artificial Sequence
  Synthetic Polynucleotide
tcttgacagcactaaaga

SEQ ID NO: 8696 - DNA, 18 bp, Artificial Sequence
  Synthetic Polynucleotide
tacaaaccaccatatctc

SEQ ID NO: 8697 - DNA, 18 bp, Artificial Sequence
  Synthetic Polynucleotide
accctcatcatacactct

SEQ ID NO: 8698 - DNA, 18 bp, Artificial Sequence
  Synthetic Polynucleotide
acttgacatcatcagacc

SEQ ID NO: 8699 - DNA, 18 bp, Artificial Sequence
  Synthetic Polynucleotide
aaacccaccaccattcct

SEQ ID NO: 8700 - DNA, 18 bp, Artificial Sequence
  Synthetic Polynucleotide
cacctttctacacctcaa

SEQ ID NO: 8701 - DNA, 18 bp, Artificial Sequence
  Synthetic Polynucleotide
tcacagtttcccaattta

SEQ ID NO: 8702 - DNA, 17 bp, Artificial Sequence
  Synthetic Polynucleotide
aacccttagaccaacac

SEQ ID NO: 8703 - DNA, 17 bp, Artificial Sequence
  Synthetic Polynucleotide
gcacccatctcactcat

SEQ ID NO: 8704 - DNA, 17 bp, Artificial Sequence
  Synthetic Polynucleotide
ctgacatccacaccact

SEQ ID NO: 8705 - DNA, 18 bp, Artificial Sequence
  Synthetic Polynucleotide
acaaatccataccaccag

SEQ ID NO: 8706 - DNA, 18 bp, Artificial Sequence
  Synthetic Polynucleotide
ttacccacccaagtaatt

SEQ ID NO: 8707 - DNA, 18 bp, Artificial Sequence
  Synthetic Polynucleotide
tacattcgccttatgaat

SEQ ID NO: 8708 - DNA, 17 bp, Artificial Sequence
  Synthetic Polynucleotide
tgtttccccatcatcaa

SEQ ID NO: 8709 - DNA, 18 bp, Artificial Sequence
  Synthetic Polynucleotide
tgacccacccaacccaat

SEQ ID NO: 8710 - DNA, 17 bp, Artificial Sequence
  Synthetic Polynucleotide
cacgcacacacatccaa

SEQ ID NO: 8711 - DNA, 18 bp, Artificial Sequence
  Synthetic Polynucleotide
actcccttatcctctcag

SEQ ID NO: 8712 - DNA, 18 bp, Artificial Sequence
  Synthetic Polynucleotide
tgaccacctcaaagaaag

SEQ ID NO: 8713 - DNA, 18 bp, Artificial Sequence
  Synthetic Polynucleotide
gctttctacactctcacc

SEQ ID NO: 8714 - DNA, 18 bp, Artificial Sequence
  Synthetic Polynucleotide
aaacaacccacaccaaca

SEQ ID NO: 8715 - DNA, 18 bp, Artificial Sequence
  Synthetic Polynucleotide
actttcacctccatcctg

SEQ ID NO: 8716 - DNA, 18 bp, Artificial Sequence
  Synthetic Polynucleotide
acacaacgctttcatttt

SEQ ID NO: 8717 - DNA, 17 bp, Artificial Sequence
  Synthetic Polynucleotide
gacagcctcctttcccc

SEQ ID NO: 8718 - DNA, 18 bp, Artificial Sequence
  Synthetic Polynucleotide
agcctaaaaccacctctg

SEQ ID NO: 8719 - DNA, 18 bp, Artificial Sequence
  Synthetic Polynucleotide
tcaaacaacttccacaaa

SEQ ID NO: 8720 - DNA, 17 bp, Artificial Sequence
  Synthetic Polynucleotide
cttcaccaccagcaaga

SEQ ID NO: 8721 - DNA, 18 bp, Artificial Sequence
  Synthetic Polynucleotide
gacaaccatcacaatcca

SEQ ID NO: 8722 - DNA, 17 bp, Artificial Sequence
  Synthetic Polynucleotide
tcacatcgccccagatt

SEQ ID NO: 8723 - DNA, 18 bp, Artificial Sequence
  Synthetic Polynucleotide
ttttgcccaatcaacctg

SEQ ID NO: 8724 - DNA, 17 bp, Artificial Sequence
  Synthetic Polynucleotide
acccaccccatcttgac

SEQ ID NO: 8725 - DNA, 17 bp, Artificial Sequence
  Synthetic Polynucleotide
tgttagcatcactagcc

SEQ ID NO: 8726 - DNA, 18 bp, Artificial Sequence
  Synthetic Polynucleotide
caccatccaacatttctt

SEQ ID NO: 8727 - DNA, 18 bp, Artificial Sequence
  Synthetic Polynucleotide
tgcataaccacccatatt

SEQ ID NO: 8728 - DNA, 18 bp, Artificial Sequence
  Synthetic Polynucleotide
tcacaaacaccttcttct

SEQ ID NO: 8729 - DNA, 18 bp, Artificial Sequence
  Synthetic Polynucleotide
atcccaagcctttattga

SEQ ID NO: 8730 - DNA, 18 bp, Artificial Sequence
  Synthetic Polynucleotide
tttcagcactagcagccc

SEQ ID NO: 8731 - DNA, 18 bp, Artificial Sequence
  Synthetic Polynucleotide
aacattgtcccttttccg

SEQ ID NO: 8732 - DNA, 17 bp, Artificial Sequence
  Synthetic Polynucleotide
tcagtctctgtaacctg

SEQ ID NO: 8733 - DNA, 18 bp, Artificial Sequence
  Synthetic Polynucleotide
gcatcatcaacaccactt

SEQ ID NO: 8734 - DNA, 17 bp, Artificial Sequence
  Synthetic Polynucleotide
tctatcagcctcagttc

SEQ ID NO: 8735 - DNA, 17 bp, Artificial Sequence
  Synthetic Polynucleotide
aacaaccacctgttaca

SEQ ID NO: 8736 - DNA, 17 bp, Artificial Sequence
  Synthetic Polynucleotide
tagtagactccgcaaga

SEQ ID NO: 8737 - DNA, 18 bp, Artificial Sequence
  Synthetic Polynucleotide
cttgacctcaatcaaagc

SEQ ID NO: 8738 - DNA, 18 bp, Artificial Sequence
  Synthetic Polynucleotide
caccaatcacacctgccc

SEQ ID NO: 8739 - DNA, 18 bp, Artificial Sequence
  Synthetic Polynucleotide
aattgtcccatacccagg

SEQ ID NO: 8740 - DNA, 18 bp, Artificial Sequence
  Synthetic Polynucleotide
tccccaaccacccaccca

SEQ ID NO: 8741 - DNA, 17 bp, Artificial Sequence
  Synthetic Polynucleotide
accttatcgcccctagt

SEQ ID NO: 8742 - DNA, 17 bp, Artificial Sequence
  Synthetic Polynucleotide
tcctctgatcccctaaa

SEQ ID NO: 8743 - DNA, 17 bp, Artificial Sequence
  Synthetic Polynucleotide
agtccaaccaagcagct

SEQ ID NO: 8744 - DNA, 17 bp, Artificial Sequence
  Synthetic Polynucleotide
tctgccttcttcctcca

SEQ ID NO: 8745 - DNA, 18 bp, Artificial Sequence
  Synthetic Polynucleotide
ctgacccaaaccaattgt

SEQ ID NO: 8746 - DNA, 18 bp, Artificial Sequence
  Synthetic Polynucleotide
tttcttcgcccaattaac

SEQ ID NO: 8747 - DNA, 18 bp, Artificial Sequence
  Synthetic Polynucleotide
ttcacttttcttcctcca

SEQ ID NO: 8748 - DNA, 17 bp, Artificial Sequence
  Synthetic Polynucleotide
gccctgttaccatagta

SEQ ID NO: 8749 - DNA, 18 bp, Artificial Sequence
  Synthetic Polynucleotide
cttatcatacagctccga

SEQ ID NO: 8750 - DNA, 18 bp, Artificial Sequence
  Synthetic Polynucleotide
ttaaatccacagtcccta

SEQ ID NO: 8751 - DNA, 18 bp, Artificial Sequence
  Synthetic Polynucleotide
tcacacctgccttccaaa

SEQ ID NO: 8752 - DNA, 17 bp, Artificial Sequence
  Synthetic Polynucleotide
ttgaccaaatacctgca

SEQ ID NO: 8753 - DNA, 17 bp, Artificial Sequence
  Synthetic Polynucleotide
gtcttaccttccaccgt

SEQ ID NO: 8754 - DNA, 18 bp, Artificial Sequence
  Synthetic Polynucleotide
ttccatcatactcacaga

SEQ ID NO: 8755 - DNA, 18 bp, Artificial Sequence
  Synthetic Polynucleotide
aaccctctgatacattgc

SEQ ID NO: 8756 - DNA, 18 bp, Artificial Sequence
  Synthetic Polynucleotide
tactcacaaactctcttg

SEQ ID NO: 8757 - DNA, 17 bp, Artificial Sequence
  Synthetic Polynucleotide
tcctattcccatgtacc

SEQ ID NO: 8758 - DNA, 17 bp, Artificial Sequence
  Synthetic Polynucleotide
ccagtccattccactgc

SEQ ID NO: 8759 - DNA, 17 bp, Artificial Sequence
  Synthetic Polynucleotide
tctcctgcctcatccat

SEQ ID NO: 8760 - DNA, 17 bp, Artificial Sequence
  Synthetic Polynucleotide
aacaccgctcgaatttt

SEQ ID NO: 8761 - DNA, 17 bp, Artificial Sequence
  Synthetic Polynucleotide
caagtccaagcctttca

SEQ ID NO: 8762 - DNA, 17 bp, Artificial Sequence
  Synthetic Polynucleotide
tgttgccttcgtccact

SEQ ID NO: 8763 - DNA, 17 bp, Artificial Sequence
  Synthetic Polynucleotide
aatccaatcacacccat

SEQ ID NO: 8764 - DNA, 18 bp, Artificial Sequence
  Synthetic Polynucleotide
ttgccctaccgataattc

SEQ ID NO: 8765 - DNA, 17 bp, Artificial Sequence
  Synthetic Polynucleotide
tccttcctcctcaacag

SEQ ID NO: 8766 - DNA, 18 bp, Artificial Sequence
  Synthetic Polynucleotide
tagacacaaaccatcata

SEQ ID NO: 8767 - DNA, 18 bp, Artificial Sequence
  Synthetic Polynucleotide
ccccaataaccactcacc

SEQ ID NO: 8768 - DNA, 18 bp, Artificial Sequence
  Synthetic Polynucleotide
tcaagcacagctaattta

SEQ ID NO: 8769 - DNA, 18 bp, Artificial Sequence
  Synthetic Polynucleotide
gaggacataaacccctat

SEQ ID NO: 8770 - DNA, 17 bp, Artificial Sequence
  Synthetic Polynucleotide
gcaacctcaaagaagta

SEQ ID NO: 8771 - DNA, 18 bp, Artificial Sequence
  Synthetic Polynucleotide
gtcactaaattgacctcg

SEQ ID NO: 8772 - DNA, 17 bp, Artificial Sequence
  Synthetic Polynucleotide
tttgccttcctcttgtt

SEQ ID NO: 8773 - DNA, 18 bp, Artificial Sequence
  Synthetic Polynucleotide
agtttcagcatccatcca

SEQ ID NO: 8774 - DNA, 17 bp, Artificial Sequence
  Synthetic Polynucleotide
gctactcactctcccat

SEQ ID NO: 8775 - DNA, 18 bp, Artificial Sequence
  Synthetic Polynucleotide
cttcacaaccccaccaag

SEQ ID NO: 8776 - DNA, 17 bp, Artificial Sequence
  Synthetic Polynucleotide
atgcagccacactctcc

SEQ ID NO: 8777 - DNA, 18 bp, Artificial Sequence
  Synthetic Polynucleotide
tattacaacactcccaac

SEQ ID NO: 8778 - DNA, 17 bp, Artificial Sequence
  Synthetic Polynucleotide
ctctcagcccaatcctt

SEQ ID NO: 8779 - DNA, 17 bp, Artificial Sequence
  Synthetic Polynucleotide
acgaccgaaacacctat

SEQ ID NO: 8780 - DNA, 17 bp, Artificial Sequence
  Synthetic Polynucleotide
ccatcattacgccgact

SEQ ID NO: 8781 - DNA, 18 bp, Artificial Sequence
  Synthetic Polynucleotide
tccctaatcatccaacag

SEQ ID NO: 8782 - DNA, 17 bp, Artificial Sequence
  Synthetic Polynucleotide
gcccttaaacccaccct

SEQ ID NO: 8783 - DNA, 17 bp, Artificial Sequence
  Synthetic Polynucleotide
aaccacttccatcttgg

SEQ ID NO: 8784 - DNA, 17 bp, Artificial Sequence
  Synthetic Polynucleotide
cccttaaacccacccta

SEQ ID NO: 8785 - DNA, 18 bp, Artificial Sequence
  Synthetic Polynucleotide
gccactatattcgcagat

SEQ ID NO: 8786 - DNA, 18 bp, Artificial Sequence
  Synthetic Polynucleotide
gctttccgcataaagttt

SEQ ID NO: 8787 - DNA, 17 bp, Artificial Sequence
  Synthetic Polynucleotide
tgcccattcctcccaaa

SEQ ID NO: 8788 - DNA, 18 bp, Artificial Sequence
  Synthetic Polynucleotide
taccacactctgtaattg

SEQ ID NO: 8789 - DNA, 18 bp, Artificial Sequence
  Synthetic Polynucleotide
gtccatacaattccatgc

SEQ ID NO: 8790 - DNA, 18 bp, Artificial Sequence
  Synthetic Polynucleotide
catttccctcagcatcta

SEQ ID NO: 8791 - DNA, 18 bp, Artificial Sequence
  Synthetic Polynucleotide
aacactgttccaaccaat

SEQ ID NO: 8792 - DNA, 17 bp, Artificial Sequence
  Synthetic Polynucleotide
ctccctctcattgcttc

SEQ ID NO: 8793 - DNA, 18 bp, Artificial Sequence
  Synthetic Polynucleotide
tcatctctcatccattgt

SEQ ID NO: 8794 - DNA, 17 bp, Artificial Sequence
  Synthetic Polynucleotide
cgctcgaattttcttcc

SEQ ID NO: 8795 - DNA, 18 bp, Artificial Sequence
  Synthetic Polynucleotide
tgcatcatattgctttcc

SEQ ID NO: 8796 - DNA, 18 bp, Artificial Sequence
  Synthetic Polynucleotide
agactccttatccactga

SEQ ID NO: 8797 - DNA, 17 bp, Artificial Sequence
  Synthetic Polynucleotide
cccctaccacccaccca

SEQ ID NO: 8798 - DNA, 17 bp, Artificial Sequence
  Synthetic Polynucleotide
atctctccttcttccca

SEQ ID NO: 8799 - DNA, 18 bp, Artificial Sequence
  Synthetic Polynucleotide
tctaaactaccccatcaa

SEQ ID NO: 8800 - DNA, 18 bp, Artificial Sequence
  Synthetic Polynucleotide
ttgcacacctgttcataa

SEQ ID NO: 8801 - DNA, 17 bp, Artificial Sequence
  Synthetic Polynucleotide
tcctttacctctcctgt

SEQ ID NO: 8802 - DNA, 18 bp, Artificial Sequence
  Synthetic Polynucleotide
tcctcaatcctctcagcc

SEQ ID NO: 8803 - DNA, 17 bp, Artificial Sequence
  Synthetic Polynucleotide
gcttcaaaaccagttga

SEQ ID NO: 8804 - DNA, 18 bp, Artificial Sequence
  Synthetic Polynucleotide
tctcctaagatagccttc

SEQ ID NO: 8805 - DNA, 17 bp, Artificial Sequence
  Synthetic Polynucleotide
tctacaaagcccagcta

SEQ ID NO: 8806 - DNA, 18 bp, Artificial Sequence
  Synthetic Polynucleotide
aagcagctcaccgagaaa

SEQ ID NO: 8807 - DNA, 17 bp, Artificial Sequence
  Synthetic Polynucleotide
atgcatttcagcatcta

SEQ ID NO: 8808 - DNA, 18 bp, Artificial Sequence
  Synthetic Polynucleotide
caccctaaaacaaccatg

SEQ ID NO: 8809 - DNA, 18 bp, Artificial Sequence
  Synthetic Polynucleotide
tgcccaaatattccattg

SEQ ID NO: 8810 - DNA, 17 bp, Artificial Sequence
  Synthetic Polynucleotide
gctctctgtttccctgt

SEQ ID NO: 8811 - DNA, 18 bp, Artificial Sequence
  Synthetic Polynucleotide
gtacgcctcagctctctg

SEQ ID NO: 8812 - DNA, 18 bp, Artificial Sequence
  Synthetic Polynucleotide
ttttagcctcttcgttta

SEQ ID NO: 8813 - DNA, 17 bp, Artificial Sequence
  Synthetic Polynucleotide
atcgcagccttatctct

SEQ ID NO: 8814 - DNA, 18 bp, Artificial Sequence
  Synthetic Polynucleotide
gctcagtttcacagtact

SEQ ID NO: 8815 - DNA, 18 bp, Artificial Sequence
  Synthetic Polynucleotide
gccttcctttcaatcctt

SEQ ID NO: 8816 - DNA, 17 bp, Artificial Sequence
  Synthetic Polynucleotide
gcaccgattattttccc

SEQ ID NO: 8817 - DNA, 18 bp, Artificial Sequence
  Synthetic Polynucleotide
tcaccataatcatccaca

SEQ ID NO: 8818 - DNA, 17 bp, Artificial Sequence
  Synthetic Polynucleotide
tcaaaccacctgttcat

SEQ ID NO: 8819 - DNA, 18 bp, Artificial Sequence
  Synthetic Polynucleotide
gtgccgcttacgcccaca

SEQ ID NO: 8820 - DNA, 18 bp, Artificial Sequence
  Synthetic Polynucleotide
gcacctttcatctttctc

SEQ ID NO: 8821 - DNA, 18 bp, Artificial Sequence
  Synthetic Polynucleotide
gggatatcgctaccattc

SEQ ID NO: 8822 - DNA, 18 bp, Artificial Sequence
  Synthetic Polynucleotide
tcagacgtttccatagta

SEQ ID NO: 8823 - DNA, 18 bp, Artificial Sequence
  Synthetic Polynucleotide
tcacattagacgtttcca

SEQ ID NO: 8824 - DNA, 18 bp, Artificial Sequence
  Synthetic Polynucleotide
tccactttcatttcatga

SEQ ID NO: 8825 - DNA, 17 bp, Artificial Sequence
  Synthetic Polynucleotide
tagtagtagactccgca

SEQ ID NO: 8826 - DNA, 17 bp, Artificial Sequence
  Synthetic Polynucleotide
cacaatcctcgaaacca

SEQ ID NO: 8827 - DNA, 18 bp, Artificial Sequence
  Synthetic Polynucleotide
ggatactaaccaccacct

SEQ ID NO: 8828 - DNA, 17 bp, Artificial Sequence
  Synthetic Polynucleotide
catccattcttccgctg

SEQ ID NO: 8829 - DNA, 18 bp, Artificial Sequence
  Synthetic Polynucleotide
ttctacccacttgtcata

SEQ ID NO: 8830 - DNA, 17 bp, Artificial Sequence
  Synthetic Polynucleotide
attcccacagtcgttag

SEQ ID NO: 8831 - DNA, 17 bp, Artificial Sequence
  Synthetic Polynucleotide
caatttccccatccacg

SEQ ID NO: 8832 - DNA, 17 bp, Artificial Sequence
  Synthetic Polynucleotide
tcccatcgctcgaatct

SEQ ID NO: 8833 - DNA, 18 bp, Artificial Sequence
  Synthetic Polynucleotide
ctttagaccagtaccagg

SEQ ID NO: 8834 - DNA, 18 bp, Artificial Sequence
  Synthetic Polynucleotide
ccctttaaaatcacctgc

SEQ ID NO: 8835 - DNA, 17 bp, Artificial Sequence
  Synthetic Polynucleotide
tcattgaccaaacgcaa

SEQ ID NO: 8836 - DNA, 17 bp, Artificial Sequence
  Synthetic Polynucleotide
ccgcacagccccaaatt

SEQ ID NO: 8837 - DNA, 17 bp, Artificial Sequence
  Synthetic Polynucleotide
cgcccttccaaaacgcc

SEQ ID NO: 8838 - DNA, 18 bp, Artificial Sequence
  Synthetic Polynucleotide
gcagctctaaaatcagta

SEQ ID NO: 8839 - DNA, 17 bp, Artificial Sequence
  Synthetic Polynucleotide
tagctcctcactaacct

SEQ ID NO: 8840 - DNA, 18 bp, Artificial Sequence
  Synthetic Polynucleotide
ttgcagcccataaaatgg

SEQ ID NO: 8841 - DNA, 18 bp, Artificial Sequence
  Synthetic Polynucleotide
cattccaagcccactata

SEQ ID NO: 8842 - DNA, 18 bp, Artificial Sequence
  Synthetic Polynucleotide
gcatcagctcccaattcg

SEQ ID NO: 8843 - DNA, 17 bp, Artificial Sequence
  Synthetic Polynucleotide
acgcttccttaacctta

SEQ ID NO: 8844 - DNA, 18 bp, Artificial Sequence
  Synthetic Polynucleotide
gctcacctcattttccac

SEQ ID NO: 8845 - DNA, 18 bp, Artificial Sequence
  Synthetic Polynucleotide
gtgccctcattcagtaaa

SEQ ID NO: 8846 - DNA, 18 bp, Artificial Sequence
  Synthetic Polynucleotide
agttccatccttagcatt

SEQ ID NO: 8847 - DNA, 17 bp, Artificial Sequence
  Synthetic Polynucleotide
accccttacacaccagc

SEQ ID NO: 8848 - DNA, 18 bp, Artificial Sequence
  Synthetic Polynucleotide
tcacaatccacagcactg

SEQ ID NO: 8849 - DNA, 18 bp, Artificial Sequence
  Synthetic Polynucleotide
ttctgtaccaacttccag

SEQ ID NO: 8850 - DNA, 18 bp, Artificial Sequence
  Synthetic Polynucleotide
cctacacttatcaacgca

SEQ ID NO: 8851 - DNA, 17 bp, Artificial Sequence
  Synthetic Polynucleotide
ctcgtccaacatcatgt

SEQ ID NO: 8852 - DNA, 18 bp, Artificial Sequence
  Synthetic Polynucleotide
acactccttcagattcag

SEQ ID NO: 8853 - DNA, 17 bp, Artificial Sequence
  Synthetic Polynucleotide
gcagacacaaactaggc

SEQ ID NO: 8854 - DNA, 17 bp, Artificial Sequence
  Synthetic Polynucleotide
gcagtccatcctttcac

SEQ ID NO: 8855 - DNA, 17 bp, Artificial Sequence
  Synthetic Polynucleotide
tcatcagctctcattgt

SEQ ID NO: 8856 - DNA, 17 bp, Artificial Sequence
  Synthetic Polynucleotide
aaacctgtagacccaac

SEQ ID NO: 8857 - DNA, 18 bp, Artificial Sequence
  Synthetic Polynucleotide
agcttccctttctattcc

SEQ ID NO: 8858 - DNA, 18 bp, Artificial Sequence
  Synthetic Polynucleotide
caaacccatgttccacat

SEQ ID NO: 8859 - DNA, 18 bp, Artificial Sequence
  Synthetic Polynucleotide
atgatcttcacctcttgg

SEQ ID NO: 8860 - DNA, 18 bp, Artificial Sequence
  Synthetic Polynucleotide
atacctcatcactcctgt

SEQ ID NO: 8861 - DNA, 18 bp, Artificial Sequence
  Synthetic Polynucleotide
tcgctcagcatttactct

SEQ ID NO: 8862 - DNA, 17 bp, Artificial Sequence
  Synthetic Polynucleotide
tgcatccatccaccagc

SEQ ID NO: 8863 - DNA, 18 bp, Artificial Sequence
  Synthetic Polynucleotide
atgacctcagcatcctca

SEQ ID NO: 8864 - DNA, 18 bp, Artificial Sequence
  Synthetic Polynucleotide
ctcaaacaaccattcacg

SEQ ID NO: 8865 - DNA, 17 bp, Artificial Sequence
  Synthetic Polynucleotide
ggacaccatcactctgt

SEQ ID NO: 8866 - DNA, 18 bp, Artificial Sequence
  Synthetic Polynucleotide
ttctcagcactcctcact

SEQ ID NO: 8867 - DNA, 17 bp, Artificial Sequence
  Synthetic Polynucleotide
tccgacagcttcaaatg

SEQ ID NO: 8868 - DNA, 18 bp, Artificial Sequence
  Synthetic Polynucleotide
ggaccaccattctacttg

SEQ ID NO: 8869 - DNA, 18 bp, Artificial Sequence
  Synthetic Polynucleotide
tcagctaccattaaaccc

SEQ ID NO: 8870 - DNA, 18 bp, Artificial Sequence
  Synthetic Polynucleotide
atattgttccaaccctgc

SEQ ID NO: 8871 - DNA, 17 bp, Artificial Sequence
  Synthetic Polynucleotide
ctcttgttccccaacat

SEQ ID NO: 8872 - DNA, 18 bp, Artificial Sequence
  Synthetic Polynucleotide
cggaccaattccaaaaga

SEQ ID NO: 8873 - DNA, 17 bp, Artificial Sequence
  Synthetic Polynucleotide
gacctccacgcagacca

SEQ ID NO: 8874 - DNA, 17 bp, Artificial Sequence
  Synthetic Polynucleotide
tccactgacatcaaagg

SEQ ID NO: 8875 - DNA, 17 bp, Artificial Sequence
  Synthetic Polynucleotide
gcatcttcatattgccc

SEQ ID NO: 8876 - DNA, 18 bp, Artificial Sequence
  Synthetic Polynucleotide
taccatccattcacagaa

SEQ ID NO: 8877 - DNA, 18 bp, Artificial Sequence
  Synthetic Polynucleotide
tctcagtcccctctacgg

SEQ ID NO: 8878 - DNA, 18 bp, Artificial Sequence
  Synthetic Polynucleotide
tcttgacagcactaaaga

SEQ ID NO: 8879 - DNA, 18 bp, Artificial Sequence
  Synthetic Polynucleotide
ccctactataccaaaccc

SEQ ID NO: 8880 - DNA, 18 bp, Artificial Sequence
  Synthetic Polynucleotide
accctcatcatacactct

SEQ ID NO: 8881 - DNA, 18 bp, Artificial Sequence
  Synthetic Polynucleotide
acttgacatcatcagacc

SEQ ID NO: 8882 - DNA, 17 bp, Artificial Sequence
  Synthetic Polynucleotide
cgaactcttcacaaccc

SEQ ID NO: 8883 - DNA, 18 bp, Artificial Sequence
  Synthetic Polynucleotide
tcagaaataccagcatta

SEQ ID NO: 8884 - DNA, 18 bp, Artificial Sequence
  Synthetic Polynucleotide
aaacccaccaccattcct

SEQ ID NO: 8885 - DNA, 18 bp, Artificial Sequence
  Synthetic Polynucleotide
cacctttctacacctcaa

SEQ ID NO: 8886 - DNA, 17 bp, Artificial Sequence
  Synthetic Polynucleotide
atggttcctcttcacta

SEQ ID NO: 8887 - DNA, 17 bp, Artificial Sequence
  Synthetic Polynucleotide
atgtacctcagcaagac

SEQ ID NO: 8888 - DNA, 18 bp, Artificial Sequence
  Synthetic Polynucleotide
acccatctcactcattcg

SEQ ID NO: 8889 - DNA, 17 bp, Artificial Sequence
  Synthetic Polynucleotide
ctgacatccacaccact

SEQ ID NO: 8890 - DNA, 18 bp, Artificial Sequence
  Synthetic Polynucleotide
acaaatccataccaccag

SEQ ID NO: 8891 - DNA, 18 bp, Artificial Sequence
  Synthetic Polynucleotide
ttacccacccaagtaatt

SEQ ID NO: 8892 - DNA, 17 bp, Artificial Sequence
  Synthetic Polynucleotide
tcaaccttcctgttagc

SEQ ID NO: 8893 - DNA, 18 bp, Artificial Sequence
  Synthetic Polynucleotide
gccaccaaagtaaaactg

SEQ ID NO: 8894 - DNA, 18 bp, Artificial Sequence
  Synthetic Polynucleotide
tgacccacccaacccaat

SEQ ID NO: 8895 - DNA, 17 bp, Artificial Sequence
  Synthetic Polynucleotide
cacgcacacacatccaa

SEQ ID NO: 8896 - DNA, 17 bp, Artificial Sequence
  Synthetic Polynucleotide
tccatcgcttacagcta

SEQ ID NO: 8897 - DNA, 18 bp, Artificial Sequence
  Synthetic Polynucleotide
cgcatcttactcttcaac

SEQ ID NO: 8898 - DNA, 17 bp, Artificial Sequence
  Synthetic Polynucleotide
ccaaattgctctcaacc

SEQ ID NO: 8899 - DNA, 18 bp, Artificial Sequence
  Synthetic Polynucleotide
tgacatcagacaccacaa

SEQ ID NO: 8900 - DNA, 17 bp, Artificial Sequence
  Synthetic Polynucleotide
ctgacctctcttccctt

SEQ ID NO: 8901 - DNA, 17 bp, Artificial Sequence
  Synthetic Polynucleotide
gcaccaactcacaaagg

SEQ ID NO: 8902 - DNA, 17 bp, Artificial Sequence
  Synthetic Polynucleotide
gacacccatctcactga

SEQ ID NO: 8903 - DNA, 17 bp, Artificial Sequence
  Synthetic Polynucleotide
cagaaaccttcccaact

SEQ ID NO: 8904 - DNA, 18 bp, Artificial Sequence
  Synthetic Polynucleotide
accatccaattcccactt

SEQ ID NO: 8905 - DNA, 17 bp, Artificial Sequence
  Synthetic Polynucleotide
ggttctagcacagctaa

SEQ ID NO: 8906 - DNA, 18 bp, Artificial Sequence
  Synthetic Polynucleotide
cacgtacaaaacccacat

SEQ ID NO: 8907 - DNA, 17 bp, Artificial Sequence
  Synthetic Polynucleotide
tctcacaaactacccta

SEQ ID NO: 8908 - DNA, 17 bp, Artificial Sequence
  Synthetic Polynucleotide
tctttgcttcacttacg

SEQ ID NO: 8909 - DNA, 18 bp, Artificial Sequence
  Synthetic Polynucleotide
aacaaaatcatcagcagc

SEQ ID NO: 8910 - DNA, 17 bp, Artificial Sequence
  Synthetic Polynucleotide
gggatacacctctcaca

SEQ ID NO: 8911 - DNA, 18 bp, Artificial Sequence
  Synthetic Polynucleotide
agttcccagcttccaagc

SEQ ID NO: 8912 - DNA, 17 bp, Artificial Sequence
  Synthetic Polynucleotide
gcaccacagcagcattt

SEQ ID NO: 8913 - DNA, 18 bp, Artificial Sequence
  Synthetic Polynucleotide
ccccaacccacttatata

SEQ ID NO: 8914 - DNA, 18 bp, Artificial Sequence
  Synthetic Polynucleotide
tcaaaccgcttatattcg

SEQ ID NO: 8915 - DNA, 17 bp, Artificial Sequence
  Synthetic Polynucleotide
gcatctaacccagcata

SEQ ID NO: 8916 - DNA, 18 bp, Artificial Sequence
  Synthetic Polynucleotide
tccacactacataccaat

SEQ ID NO: 8917 - DNA, 18 bp, Artificial Sequence
  Synthetic Polynucleotide
aattcgcccttaaactca

SEQ ID NO: 8918 - DNA, 18 bp, Artificial Sequence
  Synthetic Polynucleotide
gcaccagttatattccct

SEQ ID NO: 8919 - DNA, 17 bp, Artificial Sequence
  Synthetic Polynucleotide
acccaatccttcacaaa

SEQ ID NO: 8920 - DNA, 17 bp, Artificial Sequence
  Synthetic Polynucleotide
agcccaaacacttgtat

SEQ ID NO: 8921 - DNA, 17 bp, Artificial Sequence
  Synthetic Polynucleotide
atctctcaccttctgcc

SEQ ID NO: 8922 - DNA, 18 bp, Artificial Sequence
  Synthetic Polynucleotide
tagtagactccctaaaga

SEQ ID NO: 8923 - DNA, 17 bp, Artificial Sequence
  Synthetic Polynucleotide
cgccgctttcataagat

SEQ ID NO: 8924 - DNA, 18 bp, Artificial Sequence
  Synthetic Polynucleotide
tgtctcgcataactaacg

SEQ ID NO: 8925 - DNA, 18 bp, Artificial Sequence
  Synthetic Polynucleotide
agttcaagactcttcctg

SEQ ID NO: 8926 - DNA, 18 bp, Artificial Sequence
  Synthetic Polynucleotide
acactgttccaaccaata

SEQ ID NO: 8927 - DNA, 17 bp, Artificial Sequence
  Synthetic Polynucleotide
agcacacctcagccctt

SEQ ID NO: 8928 - DNA, 17 bp, Artificial Sequence
  Synthetic Polynucleotide
tcaactttcacaccaag

SEQ ID NO: 8929 - DNA, 18 bp, Artificial Sequence
  Synthetic Polynucleotide
ttctttccccatttcaga

SEQ ID NO: 8930 - DNA, 18 bp, Artificial Sequence
  Synthetic Polynucleotide
cgacagtctcacagtttc

SEQ ID NO: 8931 - DNA, 18 bp, Artificial Sequence
  Synthetic Polynucleotide
gcaccctatacataccaa

SEQ ID NO: 8932 - DNA, 17 bp, Artificial Sequence
  Synthetic Polynucleotide
gactcaccatacatcgg

SEQ ID NO: 8933 - DNA, 18 bp, Artificial Sequence
  Synthetic Polynucleotide
gcttcaccattaacagca

SEQ ID NO: 8934 - DNA, 17 bp, Artificial Sequence
  Synthetic Polynucleotide
tccacatcactaaccca

SEQ ID NO: 8935 - DNA, 17 bp, Artificial Sequence
  Synthetic Polynucleotide
aaatcagaccaccctgc

SEQ ID NO: 8936 - DNA, 18 bp, Artificial Sequence
  Synthetic Polynucleotide
aagacagcatttcactgt

SEQ ID NO: 8937 - DNA, 18 bp, Artificial Sequence
  Synthetic Polynucleotide
gcccttatccacttacaa

SEQ ID NO: 8938 - DNA, 18 bp, Artificial Sequence
  Synthetic Polynucleotide
tcaagtcccagacatagc

SEQ ID NO: 8939 - DNA, 18 bp, Artificial Sequence
  Synthetic Polynucleotide
agccccattcttcgcaac

SEQ ID NO: 8940 - DNA, 18 bp, Artificial Sequence
  Synthetic Polynucleotide
tacccttattacccagcc

SEQ ID NO: 8941 - DNA, 17 bp, Artificial Sequence
  Synthetic Polynucleotide
tagccttcctctctggc

SEQ ID NO: 8942 - DNA, 18 bp, Artificial Sequence
  Synthetic Polynucleotide
cagaatcactcaaccttg

SEQ ID NO: 8943 - DNA, 18 bp, Artificial Sequence
  Synthetic Polynucleotide
cacttcctttcaaccttg

SEQ ID NO: 8944 - DNA, 17 bp, Artificial Sequence
  Synthetic Polynucleotide
tgcttcacatcctctgg

SEQ ID NO: 8945 - DNA, 17 bp, Artificial Sequence
  Synthetic Polynucleotide
ccttcacatccactagg

SEQ ID NO: 8946 - DNA, 18 bp, Artificial Sequence
  Synthetic Polynucleotide
tttcctcccaaagcctaa

SEQ ID NO: 8947 - DNA, 18 bp, Artificial Sequence
  Synthetic Polynucleotide
acatcttttccattgcac

SEQ ID NO: 8948 - DNA, 18 bp, Artificial Sequence
  Synthetic Polynucleotide
tcgacctcaatccactca

SEQ ID NO: 8949 - DNA, 18 bp, Artificial Sequence
  Synthetic Polynucleotide
cccatatctctgccttat

SEQ ID NO: 8950 - DNA, 18 bp, Artificial Sequence
  Synthetic Polynucleotide
tacattcttcccattagc

SEQ ID NO: 8951 - DNA, 17 bp, Artificial Sequence
  Synthetic Polynucleotide
tcctagcacaattcctc

SEQ ID NO: 8952 - DNA, 17 bp, Artificial Sequence
  Synthetic Polynucleotide
ggccctcatccacctca

SEQ ID NO: 8953 - DNA, 18 bp, Artificial Sequence
  Synthetic Polynucleotide
gccttcttcccattcagg

SEQ ID NO: 8954 - DNA, 17 bp, Artificial Sequence
  Synthetic Polynucleotide
caagcactttcaatccg

SEQ ID NO: 8955 - DNA, 17 bp, Artificial Sequence
  Synthetic Polynucleotide
gatttcctttccccagt

SEQ ID NO: 8956 - DNA, 18 bp, Artificial Sequence
  Synthetic Polynucleotide
gaatatcatcagcccagt

SEQ ID NO: 8957 - DNA, 18 bp, Artificial Sequence
  Synthetic Polynucleotide
actccttcctcttcttct

SEQ ID NO: 8958 - DNA, 18 bp, Artificial Sequence
  Synthetic Polynucleotide
tgtagacacaaatcacca

SEQ ID NO: 8959 - DNA, 18 bp, Artificial Sequence
  Synthetic Polynucleotide
tctcccataaccatcttc

SEQ ID NO: 8960 - DNA, 18 bp, Artificial Sequence
  Synthetic Polynucleotide
gccttttaaaatcagcct

SEQ ID NO: 8961 - DNA, 18 bp, Artificial Sequence
  Synthetic Polynucleotide
caacaaatctaccatcgc

SEQ ID NO: 8962 - DNA, 18 bp, Artificial Sequence
  Synthetic Polynucleotide
ttattccctcaccactgt

SEQ ID NO: 8963 - DNA, 17 bp, Artificial Sequence
  Synthetic Polynucleotide
caagctctcattgacca

SEQ ID NO: 8964 - DNA, 17 bp, Artificial Sequence
  Synthetic Polynucleotide
atgaccttcacgaactg

SEQ ID NO: 8965 - DNA, 18 bp, Artificial Sequence
  Synthetic Polynucleotide
ggaccttcctcataaagt

SEQ ID NO: 8966 - DNA, 18 bp, Artificial Sequence
  Synthetic Polynucleotide
actccttagtttccatcc

SEQ ID NO: 8967 - DNA, 18 bp, Artificial Sequence
  Synthetic Polynucleotide
tctttcaacccaaagtct

SEQ ID NO: 8968 - DNA, 17 bp, Artificial Sequence
  Synthetic Polynucleotide
tccgtcacttgaagatt

SEQ ID NO: 8969 - DNA, 17 bp, Artificial Sequence
  Synthetic Polynucleotide
tgaatgaagatggcgtc

SEQ ID NO: 8970 - DNA, 18 bp, Artificial Sequence
  Synthetic Polynucleotide
gtgtatgagtaagggtca

SEQ ID NO: 8971 - DNA, 17 bp, Artificial Sequence
  Synthetic Polynucleotide
gcctcctacatgggaat

SEQ ID NO: 8972 - DNA, 17 bp, Artificial Sequence
  Synthetic Polynucleotide
tccaagcacaagaagtc

SEQ ID NO: 8973 - DNA, 17 bp, Artificial Sequence
  Synthetic Polynucleotide
gcgtgtgggttgaagga

SEQ ID NO: 8974 - DNA, 17 bp, Artificial Sequence
  Synthetic Polynucleotide
tatggagcagacagtgc

SEQ ID NO: 8975 - DNA, 18 bp, Artificial Sequence
  Synthetic Polynucleotide
ttctgtgaagaggaagag

SEQ ID NO: 8976 - DNA, 18 bp, Artificial Sequence
  Synthetic Polynucleotide
atgtagtagaattgccga

SEQ ID NO: 8977 - DNA, 17 bp, Artificial Sequence
  Synthetic Polynucleotide
ccaattgttgattcggc

SEQ ID NO: 8978 - DNA, 18 bp, Artificial Sequence
  Synthetic Polynucleotide
taatccagggatcaatta

SEQ ID NO: 8979 - DNA, 17 bp, Artificial Sequence
  Synthetic Polynucleotide
aagatggcgtcgaatga

SEQ ID NO: 8980 - DNA, 18 bp, Artificial Sequence
  Synthetic Polynucleotide
tttggttaatttgcccgg

SEQ ID NO: 8981 - DNA, 18 bp, Artificial Sequence
  Synthetic Polynucleotide
tcagcagtctttgtgaat

SEQ ID NO: 8982 - DNA, 17 bp, Artificial Sequence
  Synthetic Polynucleotide
cattagcgttccaggag

SEQ ID NO: 8983 - DNA, 18 bp, Artificial Sequence
  Synthetic Polynucleotide
agaaggaaacatgagtga

SEQ ID NO: 8984 - DNA, 18 bp, Artificial Sequence
  Synthetic Polynucleotide
gagtcctaacatcagcaa

SEQ ID NO: 8985 - DNA, 18 bp, Artificial Sequence
  Synthetic Polynucleotide
gtaaatgatgatggcgtc

SEQ ID NO: 8986 - DNA, 17 bp, Artificial Sequence
  Synthetic Polynucleotide
caccaatgtcctgtgaa

SEQ ID NO: 8987 - DNA, 17 bp, Artificial Sequence
  Synthetic Polynucleotide
attgcgaccgagtggag

SEQ ID NO: 8988 - DNA, 17 bp, Artificial Sequence
  Synthetic Polynucleotide
gaagggtttcaccaaca

SEQ ID NO: 8989 - DNA, 17 bp, Artificial Sequence
  Synthetic Polynucleotide
tccttttggctttccag

SEQ ID NO: 8990 - DNA, 18 bp, Artificial Sequence
  Synthetic Polynucleotide
cataggtccagatgagtc

SEQ ID NO: 8991 - DNA, 18 bp, Artificial Sequence
  Synthetic Polynucleotide
aaaggtggggttagaaat

SEQ ID NO: 8992 - DNA, 18 bp, Artificial Sequence
  Synthetic Polynucleotide
ccgtgttgacaataccaa

SEQ ID NO: 8993 - DNA, 17 bp, Artificial Sequence
  Synthetic Polynucleotide
aagaagtacatggcccg

SEQ ID NO: 8994 - DNA, 18 bp, Artificial Sequence
  Synthetic Polynucleotide
catagggagcataactgg

SEQ ID NO: 8995 - DNA, 18 bp, Artificial Sequence
  Synthetic Polynucleotide
tgtgaatgaagatggcgt

SEQ ID NO: 8996 - DNA, 18 bp, Artificial Sequence
  Synthetic Polynucleotide
ccagaagcagcagtccac

SEQ ID NO: 8997 - DNA, 17 bp, Artificial Sequence
  Synthetic Polynucleotide
atgatggcgtcgaaaga

SEQ ID NO: 8998 - DNA, 18 bp, Artificial Sequence
  Synthetic Polynucleotide
taacgtggttaacgatct

SEQ ID NO: 8999 - DNA, 18 bp, Artificial Sequence
  Synthetic Polynucleotide
tcgtgttaagggagcaac

SEQ ID NO: 9000 - DNA, 18 bp, Artificial Sequence
  Synthetic Polynucleotide
cagaggtggggtaattgc

SEQ ID NO: 9001 - DNA, 18 bp, Artificial Sequence
  Synthetic Polynucleotide
cagggtaagtttgtggag

SEQ ID NO: 9002 - DNA, 17 bp, Artificial Sequence
  Synthetic Polynucleotide
actggggatgagttgag

SEQ ID NO: 9003 - DNA, 17 bp, Artificial Sequence
  Synthetic Polynucleotide
cagggttttgaccaggc

SEQ ID NO: 9004 - DNA, 17 bp, Artificial Sequence
  Synthetic Polynucleotide
tttgacatgccgtagtc

SEQ ID NO: 9005 - DNA, 18 bp, Artificial Sequence
  Synthetic Polynucleotide
ccagacagagagaacctt

SEQ ID NO: 9006 - DNA, 18 bp, Artificial Sequence
  Synthetic Polynucleotide
tcaagtcctgtatagtgg

SEQ ID NO: 9007 - DNA, 18 bp, Artificial Sequence
  Synthetic Polynucleotide
ttttgcgagaacttgagt

SEQ ID NO: 9008 - DNA, 17 bp, Artificial Sequence
  Synthetic Polynucleotide
gggtggtacatttcagg

SEQ ID NO: 9009 - DNA, 17 bp, Artificial Sequence
  Synthetic Polynucleotide
gtttgactaccaaaccg

SEQ ID NO: 9010 - DNA, 18 bp, Artificial Sequence
  Synthetic Polynucleotide
attgggtttagagtgtga

SEQ ID NO: 9011 - DNA, 18 bp, Artificial Sequence
  Synthetic Polynucleotide
atgggatttagagcagag

SEQ ID NO: 9012 - DNA, 17 bp, Artificial Sequence
  Synthetic Polynucleotide
gcgttgtatctttggga

SEQ ID NO: 9013 - DNA, 17 bp, Artificial Sequence
  Synthetic Polynucleotide
ttgttcagagtcctcct

SEQ ID NO: 9014 - DNA, 18 bp, Artificial Sequence
  Synthetic Polynucleotide
cattgatagcagcaagca

SEQ ID NO: 9015 - DNA, 17 bp, Artificial Sequence
  Synthetic Polynucleotide
ggtccagcaagagagcc

SEQ ID NO: 9016 - DNA, 17 bp, Artificial Sequence
  Synthetic Polynucleotide
cgcgtgagatgtcctga

SEQ ID NO: 9017 - DNA, 17 bp, Artificial Sequence
  Synthetic Polynucleotide
ggagcagcagaagtcta

SEQ ID NO: 9018 - DNA, 17 bp, Artificial Sequence
  Synthetic Polynucleotide
atgctcaaaggtaggct

SEQ ID NO: 9019 - DNA, 18 bp, Artificial Sequence
  Synthetic Polynucleotide
tgcatcaggaaactttgg

SEQ ID NO: 9020 - DNA, 18 bp, Artificial Sequence
  Synthetic Polynucleotide
tcattgaccaacccactg

SEQ ID NO: 9021 - DNA, 18 bp, Artificial Sequence
  Synthetic Polynucleotide
taaagtgaccaacaacca

SEQ ID NO: 9022 - DNA, 18 bp, Artificial Sequence
  Synthetic Polynucleotide
gggcttgaagtattttcc

SEQ ID NO: 9023 - DNA, 17 bp, Artificial Sequence
  Synthetic Polynucleotide
cggatttcccaggatat

SEQ ID NO: 9024 - DNA, 18 bp, Artificial Sequence
  Synthetic Polynucleotide
gcataagcacagatcttt

SEQ ID NO: 9025 - DNA, 18 bp, Artificial Sequence
  Synthetic Polynucleotide
cctgccatatttcaacga

SEQ ID NO: 9026 - DNA, 17 bp, Artificial Sequence
  Synthetic Polynucleotide
ctccaggttcacaggca

SEQ ID NO: 9027 - DNA, 18 bp, Artificial Sequence
  Synthetic Polynucleotide
aaagaggagcgtctgtct

SEQ ID NO: 9028 - DNA, 17 bp, Artificial Sequence
  Synthetic Polynucleotide
tccgatgagatgaacag

SEQ ID NO: 9029 - DNA, 18 bp, Artificial Sequence
  Synthetic Polynucleotide
agtttaattgcagcagct

SEQ ID NO: 9030 - DNA, 17 bp, Artificial Sequence
  Synthetic Polynucleotide
atacacccgtcagtctc

SEQ ID NO: 9031 - DNA, 17 bp, Artificial Sequence
  Synthetic Polynucleotide
cagaaagcatcccatgg

SEQ ID NO: 9032 - DNA, 17 bp, Artificial Sequence
  Synthetic Polynucleotide
ggcggaatattgacctg

SEQ ID NO: 9033 - DNA, 18 bp, Artificial Sequence
  Synthetic Polynucleotide
gagcaccaccagtaagaa

SEQ ID NO: 9034 - DNA, 18 bp, Artificial Sequence
  Synthetic Polynucleotide
agctcttggttagcgttt

SEQ ID NO: 9035 - DNA, 18 bp, Artificial Sequence
  Synthetic Polynucleotide
tgttctaggggagaacgt

SEQ ID NO: 9036 - DNA, 18 bp, Artificial Sequence
  Synthetic Polynucleotide
tgtgtccagttttcttta

SEQ ID NO: 9037 - DNA, 18 bp, Artificial Sequence
  Synthetic Polynucleotide
tgcacaacaccagaggaa

SEQ ID NO: 9038 - DNA, 17 bp, Artificial Sequence
  Synthetic Polynucleotide
tccattcgcacatccat

SEQ ID NO: 9039 - DNA, 17 bp, Artificial Sequence
  Synthetic Polynucleotide
aggcgaaaagacaaagg

SEQ ID NO: 9040 - DNA, 18 bp, Artificial Sequence
  Synthetic Polynucleotide
ggcataatgtccttcttc

SEQ ID NO: 9041 - DNA, 18 bp, Artificial Sequence
  Synthetic Polynucleotide
taaatcaggaagcagaaa

SEQ ID NO: 9042 - DNA, 17 bp, Artificial Sequence
  Synthetic Polynucleotide
tccatacaaccgtcagc

SEQ ID NO: 9043 - DNA, 18 bp, Artificial Sequence
  Synthetic Polynucleotide
atgccattcggtcttaaa

SEQ ID NO: 9044 - DNA, 18 bp, Artificial Sequence
  Synthetic Polynucleotide
tgcagcattgtatagagg

SEQ ID NO: 9045 - DNA, 18 bp, Artificial Sequence
  Synthetic Polynucleotide
acaacgtcttcaaaggga

SEQ ID NO: 9046 - DNA, 18 bp, Artificial Sequence
  Synthetic Polynucleotide
tgcgtcaagtagttagtt

SEQ ID NO: 9047 - DNA, 18 bp, Artificial Sequence
  Synthetic Polynucleotide
aagaaacctatcgtccga

SEQ ID NO: 9048 - DNA, 18 bp, Artificial Sequence
  Synthetic Polynucleotide
cttacatcatgacagcac

SEQ ID NO: 9049 - DNA, 18 bp, Artificial Sequence
  Synthetic Polynucleotide
tacacagtccaatccaat

SEQ ID NO: 9050 - DNA, 18 bp, Artificial Sequence
  Synthetic Polynucleotide
agccagtaggattccatt

SEQ ID NO: 9051 - DNA, 18 bp, Artificial Sequence
  Synthetic Polynucleotide
gggagaaaagaatgaacg

SEQ ID NO: 9052 - DNA, 18 bp, Artificial Sequence
  Synthetic Polynucleotide
cgaccatatgattgttcc

SEQ ID NO: 9053 - DNA, 18 bp, Artificial Sequence
  Synthetic Polynucleotide
tattcatattgcaccaga

SEQ ID NO: 9054 - DNA, 18 bp, Artificial Sequence
  Synthetic Polynucleotide
ccaacaccaacccacagt

SEQ ID NO: 9055 - DNA, 18 bp, Artificial Sequence
  Synthetic Polynucleotide
agtgaagcatcttccagt

SEQ ID NO: 9056 - DNA, 18 bp, Artificial Sequence
  Synthetic Polynucleotide
tttcttctgaccaactgt

SEQ ID NO: 9057 - DNA, 18 bp, Artificial Sequence
  Synthetic Polynucleotide
aacaaactctcaactcgc

SEQ ID NO: 9058 - DNA, 18 bp, Artificial Sequence
  Synthetic Polynucleotide
agaaattcaccatgccgg

SEQ ID NO: 9059 - DNA, 17 bp, Artificial Sequence
  Synthetic Polynucleotide
gcccaaacaaagcactg

SEQ ID NO: 9060 - DNA, 18 bp, Artificial Sequence
  Synthetic Polynucleotide
tagttcgactaggatcat

SEQ ID NO: 9061 - DNA, 18 bp, Artificial Sequence
  Synthetic Polynucleotide
cctttcccacaaggatta

SEQ ID NO: 9062 - DNA, 18 bp, Artificial Sequence
  Synthetic Polynucleotide
ttcctcgtccgatgactc

SEQ ID NO: 9063 - DNA, 18 bp, Artificial Sequence
  Synthetic Polynucleotide
gctcaggcaacccaaacg

SEQ ID NO: 9064 - DNA, 18 bp, Artificial Sequence
  Synthetic Polynucleotide
ttgtgagtccaattttga

SEQ ID NO: 9065 - DNA, 18 bp, Artificial Sequence
  Synthetic Polynucleotide
tacccaccatctaacagg

SEQ ID NO: 9066 - DNA, 18 bp, Artificial Sequence
  Synthetic Polynucleotide
cggcatctacctctgtac

SEQ ID NO: 9067 - DNA, 17 bp, Artificial Sequence
  Synthetic Polynucleotide
ctcagggtcacgaaacg

SEQ ID NO: 9068 - DNA, 17 bp, Artificial Sequence
  Synthetic Polynucleotide
cccaaccttagttgctc

SEQ ID NO: 9069 - DNA, 17 bp, Artificial Sequence
  Synthetic Polynucleotide
gtccatgctctccgcta

SEQ ID NO: 9070 - DNA, 17 bp, Artificial Sequence
  Synthetic Polynucleotide
ccaagcaagcccgccat

SEQ ID NO: 9071 - DNA, 18 bp, Artificial Sequence
  Synthetic Polynucleotide
acagtactaacacggata

SEQ ID NO: 9072 - DNA, 18 bp, Artificial Sequence
  Synthetic Polynucleotide
cgggatacacgctatggt

SEQ ID NO: 9073 - DNA, 18 bp, Artificial Sequence
  Synthetic Polynucleotide
gcggcacctcacagtgta

SEQ ID NO: 9074 - DNA, 18 bp, Artificial Sequence
  Synthetic Polynucleotide
gcacatgacagcaatgtt

SEQ ID NO: 9075 - DNA, 18 bp, Artificial Sequence
  Synthetic Polynucleotide
aacaggtccagtgaagtt

SEQ ID NO: 9076 - DNA, 17 bp, Artificial Sequence
  Synthetic Polynucleotide
tattgatgggatcagga

SEQ ID NO: 9077 - DNA, 18 bp, Artificial Sequence
  Synthetic Polynucleotide
cccttaaaatccagcaca

SEQ ID NO: 9078 - DNA, 17 bp, Artificial Sequence
  Synthetic Polynucleotide
ggaatgggaataccaga

SEQ ID NO: 9079 - DNA, 18 bp, Artificial Sequence
  Synthetic Polynucleotide
aattgagaacggtgttta

SEQ ID NO: 9080 - DNA, 18 bp, Artificial Sequence
  Synthetic Polynucleotide
acgaacagcactcagcat

SEQ ID NO: 9081 - DNA, 18 bp, Artificial Sequence
  Synthetic Polynucleotide
tctcagtagatcatccca

SEQ ID NO: 9082 - DNA, 17 bp, Artificial Sequence
  Synthetic Polynucleotide
ttttgaaagtgagcggg

SEQ ID NO: 9083 - DNA, 18 bp, Artificial Sequence
  Synthetic Polynucleotide
agtggcaaggagctgaaa

SEQ ID NO: 9084 - DNA, 17 bp, Artificial Sequence
  Synthetic Polynucleotide
gacagcggtatcgtaga

SEQ ID NO: 9085 - DNA, 17 bp, Artificial Sequence
  Synthetic Polynucleotide
actcgaaggtatgtcga

SEQ ID NO: 9086 - DNA, 18 bp, Artificial Sequence
  Synthetic Polynucleotide
taaccctacctttgaaga

SEQ ID NO: 9087 - DNA, 17 bp, Artificial Sequence
  Synthetic Polynucleotide
ggatcccactacaagga

SEQ ID NO: 9088 - DNA, 18 bp, Artificial Sequence
  Synthetic Polynucleotide
caaggaggactgtgaccc

SEQ ID NO: 9089 - DNA, 18 bp, Artificial Sequence
  Synthetic Polynucleotide
ctgtaccaggcatcgggg

SEQ ID NO: 9090 - DNA, 17 bp, Artificial Sequence
  Synthetic Polynucleotide
ttgcgggaagagccgtt

SEQ ID NO: 9091 - DNA, 17 bp, Artificial Sequence
  Synthetic Polynucleotide
gcagttgaggagtacca

SEQ ID NO: 9092 - DNA, 18 bp, Artificial Sequence
  Synthetic Polynucleotide
cttagcaacaaactgggt

SEQ ID NO: 9093 - DNA, 17 bp, Artificial Sequence
  Synthetic Polynucleotide
cgcaacgtgattggaag

SEQ ID NO: 9094 - DNA, 18 bp, Artificial Sequence
  Synthetic Polynucleotide
acataagtcgtcgggtac

SEQ ID NO: 9095 - DNA, 18 bp, Artificial Sequence
  Synthetic Polynucleotide
tcctgagtctgcgaaaga

SEQ ID NO: 9096 - DNA, 17 bp, Artificial Sequence
  Synthetic Polynucleotide
accgtcccaaacaagcc

SEQ ID NO: 9097 - DNA, 18 bp, Artificial Sequence
  Synthetic Polynucleotide
tcagatatgggcggggcc

SEQ ID NO: 9098 - DNA, 17 bp, Artificial Sequence
  Synthetic Polynucleotide
tcagaggcaagtctcga

SEQ ID NO: 9099 - DNA, 17 bp, Artificial Sequence
  Synthetic Polynucleotide
ctacgtcaagtatgggc

SEQ ID NO: 9100 - DNA, 17 bp, Artificial Sequence
  Synthetic Polynucleotide
cctcggggaacttcact

SEQ ID NO: 9101 - DNA, 18 bp, Artificial Sequence
  Synthetic Polynucleotide
cccaacaatccaaacccc

SEQ ID NO: 9102 - DNA, 18 bp, Artificial Sequence
  Synthetic Polynucleotide
ggagattcactcgtgttt

SEQ ID NO: 9103 - DNA, 17 bp, Artificial Sequence
  Synthetic Polynucleotide
cgaggaacagaagaggg

SEQ ID NO: 9104 - DNA, 17 bp, Artificial Sequence
  Synthetic Polynucleotide
ttaaccatagagcagcc

SEQ ID NO: 9105 - DNA, 18 bp, Artificial Sequence
  Synthetic Polynucleotide
gtgcgggagcatgtgtcc

SEQ ID NO: 9106 - DNA, 17 bp, Artificial Sequence
  Synthetic Polynucleotide
acttaccatgatcggta

SEQ ID NO: 9107 - DNA, 18 bp, Artificial Sequence
  Synthetic Polynucleotide
taaaactcgatccgacgt

SEQ ID NO: 9108 - DNA, 17 bp, Artificial Sequence
  Synthetic Polynucleotide
tagcgaaaacgactact

SEQ ID NO: 9109 - DNA, 17 bp, Artificial Sequence
  Synthetic Polynucleotide
ctctcagaccgcctctc

SEQ ID NO: 9110 - DNA, 17 bp, Artificial Sequence
  Synthetic Polynucleotide
cgaagagaaccgtgttt

SEQ ID NO: 9111 - DNA, 18 bp, Artificial Sequence
  Synthetic Polynucleotide
aaccatcttttctaccga

SEQ ID NO: 9112 - DNA, 17 bp, Artificial Sequence
  Synthetic Polynucleotide
tttacccgaggtctagt

SEQ ID NO: 9113 - DNA, 18 bp, Artificial Sequence
  Synthetic Polynucleotide
tttccaaggtccgtctca

SEQ ID NO: 9114 - DNA, 18 bp, Artificial Sequence
  Synthetic Polynucleotide
tagagtcatacacctgag

SEQ ID NO: 9115 - DNA, 18 bp, Artificial Sequence
  Synthetic Polynucleotide
aaggagcaatctcccgaa

SEQ ID NO: 9116 - DNA, 17 bp, Artificial Sequence
  Synthetic Polynucleotide
gtgtgtaattgttccgc

SEQ ID NO: 9117 - DNA, 17 bp, Artificial Sequence
  Synthetic Polynucleotide
ggcctccatcccaaagt

SEQ ID NO: 9118 - DNA, 18 bp, Artificial Sequence
  Synthetic Polynucleotide
gaactggatctccaaaca

SEQ ID NO: 9119 - DNA, 17 bp, Artificial Sequence
  Synthetic Polynucleotide
atgaacctccaaccata

SEQ ID NO: 9120 - DNA, 18 bp, Artificial Sequence
  Synthetic Polynucleotide
gaaagtcattccagctac

SEQ ID NO: 9121 - DNA, 17 bp, Artificial Sequence
  Synthetic Polynucleotide
aattagccctctgtctg

SEQ ID NO: 9122 - DNA, 17 bp, Artificial Sequence
  Synthetic Polynucleotide
gtgaaggaactgtctcc

SEQ ID NO: 9123 - DNA, 17 bp, Artificial Sequence
  Synthetic Polynucleotide
tgttcgacaaccaagtg

SEQ ID NO: 9124 - DNA, 18 bp, Artificial Sequence
  Synthetic Polynucleotide
ccagtcttacccgattta

SEQ ID NO: 9125 - DNA, 17 bp, Artificial Sequence
  Synthetic Polynucleotide
gtagcattcgaccaaac

SEQ ID NO: 9126 - DNA, 18 bp, Artificial Sequence
  Synthetic Polynucleotide
tcgaaaacgtacccgatg

SEQ ID NO: 9127 - DNA, 18 bp, Artificial Sequence
  Synthetic Polynucleotide
ccttgagtgaagtgacgt

SEQ ID NO: 9128 - DNA, 17 bp, Artificial Sequence
  Synthetic Polynucleotide
attcagcgtgcttttac

SEQ ID NO: 9129 - DNA, 17 bp, Artificial Sequence
  Synthetic Polynucleotide
aacttagaaagccccac

SEQ ID NO: 9130 - DNA, 17 bp, Artificial Sequence
  Synthetic Polynucleotide
agacatctctccaagcg

SEQ ID NO: 9131 - DNA, 17 bp, Artificial Sequence
  Synthetic Polynucleotide
gcctgatcttcaaatcg

SEQ ID NO: 9132 - DNA, 17 bp, Artificial Sequence
  Synthetic Polynucleotide
ggattctcagcaaaacc

SEQ ID NO: 9133 - DNA, 18 bp, Artificial Sequence
  Synthetic Polynucleotide
tagaagagccacctttcg

SEQ ID NO: 9134 - DNA, 17 bp, Artificial Sequence
  Synthetic Polynucleotide
gcgtaggtttaccaaag

SEQ ID NO: 9135 - DNA, 18 bp, Artificial Sequence
  Synthetic Polynucleotide
aagcttttatcagcgatc

SEQ ID NO: 9136 - DNA, 18 bp, Artificial Sequence
  Synthetic Polynucleotide
agactcgtaagtgcctgc

SEQ ID NO: 9137 - DNA, 18 bp, Artificial Sequence
  Synthetic Polynucleotide
atccatcttcaagcgact

SEQ ID NO: 9138 - DNA, 18 bp, Artificial Sequence
  Synthetic Polynucleotide
tccttacttctcgatctt

SEQ ID NO: 9139 - DNA, 18 bp, Artificial Sequence
  Synthetic Polynucleotide
gcatttgaccaccaagtt

SEQ ID NO: 9140 - DNA, 18 bp, Artificial Sequence
  Synthetic Polynucleotide
ctgttgatgaaatgccag

SEQ ID NO: 9141 - DNA, 18 bp, Artificial Sequence
  Synthetic Polynucleotide
ttggacaactcagtgccg

SEQ ID NO: 9142 - DNA, 17 bp, Artificial Sequence
  Synthetic Polynucleotide
tttcaatccccacccgc

SEQ ID NO: 9143 - DNA, 17 bp, Artificial Sequence
  Synthetic Polynucleotide
gccaacaaccgaaactg

SEQ ID NO: 9144 - DNA, 18 bp, Artificial Sequence
  Synthetic Polynucleotide
cgtgtccgtgatgcgatc

SEQ ID NO: 9145 - DNA, 17 bp, Artificial Sequence
  Synthetic Polynucleotide
tcaccaacatctgactt

SEQ ID NO: 9146 - DNA, 18 bp, Artificial Sequence
  Synthetic Polynucleotide
tgaaacccacatagagtg

SEQ ID NO: 9147 - DNA, 18 bp, Artificial Sequence
  Synthetic Polynucleotide
ttagcattcccagcttta

SEQ ID NO: 9148 - DNA, 18 bp, Artificial Sequence
  Synthetic Polynucleotide
agtgcatatcttcctgtg

SEQ ID NO: 9149 - DNA, 17 bp, Artificial Sequence
  Synthetic Polynucleotide
tcgaaatatcctttgcg

SEQ ID NO: 9150 - DNA, 18 bp, Artificial Sequence
  Synthetic Polynucleotide
agcgtgcaatagtgaatg

SEQ ID NO: 9151 - DNA, 18 bp, Artificial Sequence
  Synthetic Polynucleotide
tttccctttcccaatcaa

SEQ ID NO: 9152 - DNA, 17 bp, Artificial Sequence
  Synthetic Polynucleotide
tatcttccgaccatctt

SEQ ID NO: 9153 - DNA, 18 bp, Artificial Sequence
  Synthetic Polynucleotide
tttgtgtccaacatagca

SEQ ID NO: 9154 - DNA, 18 bp, Artificial Sequence
  Synthetic Polynucleotide
ccctggtgatctggagta

SEQ ID NO: 9155 - DNA, 18 bp, Artificial Sequence
  Synthetic Polynucleotide
cgctttaaatcacactcc

SEQ ID NO: 9156 - DNA, 18 bp, Artificial Sequence
  Synthetic Polynucleotide
aacaaacagctttcgttc

SEQ ID NO: 9157 - DNA, 18 bp, Artificial Sequence
  Synthetic Polynucleotide
aaacaacaatgctcgtta

SEQ ID NO: 9158 - DNA, 18 bp, Artificial Sequence
  Synthetic Polynucleotide
aagagaatatccatcccg

SEQ ID NO: 9159 - DNA, 18 bp, Artificial Sequence
  Synthetic Polynucleotide
acaacctccattgcagtg

SEQ ID NO: 9160 - DNA, 17 bp, Artificial Sequence
  Synthetic Polynucleotide
ccttaagaagcaacgct

SEQ ID NO: 9161 - DNA, 17 bp, Artificial Sequence
  Synthetic Polynucleotide
gcaaagagtgccgcagc

SEQ ID NO: 9162 - DNA, 17 bp, Artificial Sequence
  Synthetic Polynucleotide
ctccttccgccaaactg

SEQ ID NO: 9163 - DNA, 18 bp, Artificial Sequence
  Synthetic Polynucleotide
cctgggtctggtttagat

SEQ ID NO: 9164 - DNA, 17 bp, Artificial Sequence
  Synthetic Polynucleotide
tccgtatgggtctatgc

SEQ ID NO: 9165 - DNA, 17 bp, Artificial Sequence
  Synthetic Polynucleotide
ccggtcgtctggctact

SEQ ID NO: 9166 - DNA, 18 bp, Artificial Sequence
  Synthetic Polynucleotide
ctgcttgtgtaaatgagc

SEQ ID NO: 9167 - DNA, 17 bp, Artificial Sequence
  Synthetic Polynucleotide
tcgccacttaaaacata

SEQ ID NO: 9168 - DNA, 17 bp, Artificial Sequence
  Synthetic Polynucleotide
tcgacttatccatctga

SEQ ID NO: 9169 - DNA, 17 bp, Artificial Sequence
  Synthetic Polynucleotide
gcacaacctcaaagagg

SEQ ID NO: 9170 - DNA, 18 bp, Artificial Sequence
  Synthetic Polynucleotide
atgtctttcttctggtgg

SEQ ID NO: 9171 - DNA, 18 bp, Artificial Sequence
  Synthetic Polynucleotide
aagttcaaatctgacacg

SEQ ID NO: 9172 - DNA, 17 bp, Artificial Sequence
  Synthetic Polynucleotide
cggctttcaaagtgaaa

SEQ ID NO: 9173 - DNA, 17 bp, Artificial Sequence
  Synthetic Polynucleotide
acaaaggtcatggaacc

SEQ ID NO: 9174 - DNA, 18 bp, Artificial Sequence
  Synthetic Polynucleotide
gtctattgcagaattgcg

SEQ ID NO: 9175 - DNA, 17 bp, Artificial Sequence
  Synthetic Polynucleotide
ttcccgaggactatgca

SEQ ID NO: 9176 - DNA, 18 bp, Artificial Sequence
  Synthetic Polynucleotide
ggtgacttatggtgatga

SEQ ID NO: 9177 - DNA, 17 bp, Artificial Sequence
  Synthetic Polynucleotide
ggacaaacaacacactg

SEQ ID NO: 9178 - DNA, 18 bp, Artificial Sequence
  Synthetic Polynucleotide
tgagatgccctggtgctg

SEQ ID NO: 9179 - DNA, 18 bp, Artificial Sequence
  Synthetic Polynucleotide
tctatgccctcatcccct

SEQ ID NO: 9180 - DNA, 17 bp, Artificial Sequence
  Synthetic Polynucleotide
aagctttcgtaccctct

SEQ ID NO: 9181 - DNA, 18 bp, Artificial Sequence
  Synthetic Polynucleotide
cttccttccctgccattg

SEQ ID NO: 9182 - DNA, 17 bp, Artificial Sequence
  Synthetic Polynucleotide
ttcgtgctagaacatgg

SEQ ID NO: 9183 - DNA, 17 bp, Artificial Sequence
  Synthetic Polynucleotide
gctttattgccctgctc

SEQ ID NO: 9184 - DNA, 18 bp, Artificial Sequence
  Synthetic Polynucleotide
aacttctcctcaatgtga

SEQ ID NO: 9185 - DNA, 18 bp, Artificial Sequence
  Synthetic Polynucleotide
tgtccaagtttactaccc

SEQ ID NO: 9186 - DNA, 18 bp, Artificial Sequence
  Synthetic Polynucleotide
cagagacaagagtgccac

SEQ ID NO: 9187 - DNA, 18 bp, Artificial Sequence
  Synthetic Polynucleotide
ttccaataatccacagcg

SEQ ID NO: 9188 - DNA, 17 bp, Artificial Sequence
  Synthetic Polynucleotide
gagtcaatccgtactcg

SEQ ID NO: 9189 - DNA, 17 bp, Artificial Sequence
  Synthetic Polynucleotide
cctcaacctcagcaaat

SEQ ID NO: 9190 - DNA, 17 bp, Artificial Sequence
  Synthetic Polynucleotide
ggccaatatgcccaatt

SEQ ID NO: 9191 - DNA, 17 bp, Artificial Sequence
  Synthetic Polynucleotide
ggccaatcctattccac

SEQ ID NO: 9192 - DNA, 18 bp, Artificial Sequence
  Synthetic Polynucleotide
tttcaggagtttccacaa

SEQ ID NO: 9193 - DNA, 18 bp, Artificial Sequence
  Synthetic Polynucleotide
cccctaaaatatcggtga

SEQ ID NO: 9194 - DNA, 17 bp, Artificial Sequence
  Synthetic Polynucleotide
caaccccaatccttgtg

SEQ ID NO: 9195 - DNA, 17 bp, Artificial Sequence
  Synthetic Polynucleotide
actcgttaacctctccg

SEQ ID NO: 9196 - DNA, 18 bp, Artificial Sequence
  Synthetic Polynucleotide
taaaatctgggatcgtgt

SEQ ID NO: 9197 - DNA, 18 bp, Artificial Sequence
  Synthetic Polynucleotide
tatccgacatcagagagt

SEQ ID NO: 9198 - DNA, 18 bp, Artificial Sequence
  Synthetic Polynucleotide
caggtgacatggttcaga

SEQ ID NO: 9199 - DNA, 18 bp, Artificial Sequence
  Synthetic Polynucleotide
ttgtttccctttctcacc

SEQ ID NO: 9200 - DNA, 18 bp, Artificial Sequence
  Synthetic Polynucleotide
tccgttagattcagtgct

SEQ ID NO: 9201 - DNA, 17 bp, Artificial Sequence
  Synthetic Polynucleotide
agcgttcgtgatgtagc

SEQ ID NO: 9202 - DNA, 18 bp, Artificial Sequence
  Synthetic Polynucleotide
tggaaagtgaacttgtca

SEQ ID NO: 9203 - DNA, 17 bp, Artificial Sequence
  Synthetic Polynucleotide
aagcagtagttgcatca

SEQ ID NO: 9204 - DNA, 17 bp, Artificial Sequence
  Synthetic Polynucleotide
tgtgatcgtgctatgcc

SEQ ID NO: 9205 - DNA, 18 bp, Artificial Sequence
  Synthetic Polynucleotide
gaagccgagaccgtattt

SEQ ID NO: 9206 - DNA, 18 bp, Artificial Sequence
  Synthetic Polynucleotide
tctctgccagtgacgtgt

SEQ ID NO: 9207 - DNA, 18 bp, Artificial Sequence
  Synthetic Polynucleotide
agttgtaccaccaggttt

SEQ ID NO: 9208 - DNA, 18 bp, Artificial Sequence
  Synthetic Polynucleotide
ggactatcctaagtgtga

SEQ ID NO: 9209 - DNA, 18 bp, Artificial Sequence
  Synthetic Polynucleotide
tagaatgatagccacaag

SEQ ID NO: 9210 - DNA, 18 bp, Artificial Sequence
  Synthetic Polynucleotide
catgttggctaaaatggg

SEQ ID NO: 9211 - DNA, 17 bp, Artificial Sequence
  Synthetic Polynucleotide
taaacccagtcctcagg

SEQ ID NO: 9212 - DNA, 18 bp, Artificial Sequence
  Synthetic Polynucleotide
tggacatttggaaaacga

SEQ ID NO: 9213 - DNA, 18 bp, Artificial Sequence
  Synthetic Polynucleotide
tgacactacccttgtagt

SEQ ID NO: 9214 - DNA, 18 bp, Artificial Sequence
  Synthetic Polynucleotide
taggtgtagtcgtattgt

SEQ ID NO: 9215 - DNA, 17 bp, Artificial Sequence
  Synthetic Polynucleotide
gcagcaaaacagtatga

SEQ ID NO: 9216 - DNA, 17 bp, Artificial Sequence
  Synthetic Polynucleotide
tgcatttgtttcccaag

SEQ ID NO: 9217 - DNA, 17 bp, Artificial Sequence
  Synthetic Polynucleotide
atcgctctacaatccag

SEQ ID NO: 9218 - DNA, 18 bp, Artificial Sequence
  Synthetic Polynucleotide
cagccttcctccggttcc

SEQ ID NO: 9219 - DNA, 18 bp, Artificial Sequence
  Synthetic Polynucleotide
gtggtcatagaggtagcc

SEQ ID NO: 9220 - DNA, 17 bp, Artificial Sequence
  Synthetic Polynucleotide
cagaactccgtcctata

SEQ ID NO: 9221 - DNA, 17 bp, Artificial Sequence
  Synthetic Polynucleotide
ttcttttcatccgcagt

SEQ ID NO: 9222 - DNA, 18 bp, Artificial Sequence
  Synthetic Polynucleotide
tgaagtcttttcaccaca

SEQ ID NO: 9223 - DNA, 18 bp, Artificial Sequence
  Synthetic Polynucleotide
tctctctagatgttgcac

SEQ ID NO: 9224 - DNA, 18 bp, Artificial Sequence
  Synthetic Polynucleotide
cttacagctcttgaaacc

SEQ ID NO: 9225 - DNA, 18 bp, Artificial Sequence
  Synthetic Polynucleotide
gtttcggcaaattcaccc

SEQ ID NO: 9226 - DNA, 18 bp, Artificial Sequence
  Synthetic Polynucleotide
gtgtaaatcgtgactcgt

SEQ ID NO: 9227 - DNA, 18 bp, Artificial Sequence
  Synthetic Polynucleotide
gaacacatggtccaccgg

SEQ ID NO: 9228 - DNA, 18 bp, Artificial Sequence
  Synthetic Polynucleotide
tggtgaacgccatgacct

SEQ ID NO: 9229 - DNA, 17 bp, Artificial Sequence
  Synthetic Polynucleotide
ccgtgatgccaacgacg

SEQ ID NO: 9230 - DNA, 18 bp, Artificial Sequence
  Synthetic Polynucleotide
ctcgccagatagcaaaac

SEQ ID NO: 9231 - DNA, 18 bp, Artificial Sequence
  Synthetic Polynucleotide
tccagttcaatgatccgc

SEQ ID NO: 9232 - DNA, 17 bp, Artificial Sequence
  Synthetic Polynucleotide
gcattgttcttcgtgct

SEQ ID NO: 9233 - DNA, 18 bp, Artificial Sequence
  Synthetic Polynucleotide
agcaagagcagtaccgtt

SEQ ID NO: 9234 - DNA, 17 bp, Artificial Sequence
  Synthetic Polynucleotide
gctagccgtatttccgg

SEQ ID NO: 9235 - DNA, 18 bp, Artificial Sequence
  Synthetic Polynucleotide
ccgacaaccacatgcagt

SEQ ID NO: 9236 - DNA, 17 bp, Artificial Sequence
  Synthetic Polynucleotide
atcttggagatcaaccc

SEQ ID NO: 9237 - DNA, 17 bp, Artificial Sequence
  Synthetic Polynucleotide
cgtcttgatgacgacag

SEQ ID NO: 9238 - DNA, 18 bp, Artificial Sequence
  Synthetic Polynucleotide
tgcctgtccgatctactc

SEQ ID NO: 9239 - DNA, 18 bp, Artificial Sequence
  Synthetic Polynucleotide
tgtgagttaccaacccgg

SEQ ID NO: 9240 - DNA, 17 bp, Artificial Sequence
  Synthetic Polynucleotide
gggtttctgttcctctc

SEQ ID NO: 9241 - DNA, 17 bp, Artificial Sequence
  Synthetic Polynucleotide
cgacgctatgactacgc

SEQ ID NO: 9242 - DNA, 17 bp, Artificial Sequence
  Synthetic Polynucleotide
aacaccgatttcaacgt

SEQ ID NO: 9243 - DNA, 17 bp, Artificial Sequence
  Synthetic Polynucleotide
agatgtatcccgactga

SEQ ID NO: 9244 - DNA, 17 bp, Artificial Sequence
  Synthetic Polynucleotide
gttgtccagccccttca

SEQ ID NO: 9245 - DNA, 17 bp, Artificial Sequence
  Synthetic Polynucleotide
caagagcccaattcccg

SEQ ID NO: 9246 - DNA, 17 bp, Artificial Sequence
  Synthetic Polynucleotide
catcgctgaagagactg

SEQ ID NO: 9247 - DNA, 17 bp, Artificial Sequence
  Synthetic Polynucleotide
agacctgcccagacgag

SEQ ID NO: 9248 - DNA, 18 bp, Artificial Sequence
  Synthetic Polynucleotide
cgctttatcgcagctcgc

SEQ ID NO: 9249 - DNA, 18 bp, Artificial Sequence
  Synthetic Polynucleotide
catgatttcgatgtccgg

SEQ ID NO: 9250 - DNA, 17 bp, Artificial Sequence
  Synthetic Polynucleotide
accgcttccgccaactt

SEQ ID NO: 9251 - DNA, 17 bp, Artificial Sequence
  Synthetic Polynucleotide
ctgtgcgtatcatccat

SEQ ID NO: 9252 - DNA, 18 bp, Artificial Sequence
  Synthetic Polynucleotide
atgatgtggaaactccaa

SEQ ID NO: 9253 - DNA, 18 bp, Artificial Sequence
  Synthetic Polynucleotide
tcaactacagcactttcg

SEQ ID NO: 9254 - DNA, 18 bp, Artificial Sequence
  Synthetic Polynucleotide
gcgcctacgtgtccgaaa

SEQ ID NO: 9255 - DNA, 18 bp, Artificial Sequence
  Synthetic Polynucleotide
agcgaatgttgaatttgc

SEQ ID NO: 9256 - DNA, 18 bp, Artificial Sequence
  Synthetic Polynucleotide
ttgaattgcagtaccgcc

SEQ ID NO: 9257 - DNA, 18 bp, Artificial Sequence
  Synthetic Polynucleotide
ggcttcatacacacttcc

SEQ ID NO: 9258 - DNA, 18 bp, Artificial Sequence
  Synthetic Polynucleotide
gtgcgtgatgaccaatct

SEQ ID NO: 9259 - DNA, 18 bp, Artificial Sequence
  Synthetic Polynucleotide
ggtatagaacatcccgaa

SEQ ID NO: 9260 - DNA, 18 bp, Artificial Sequence
  Synthetic Polynucleotide
attgttcttcaatggtgc

SEQ ID NO: 9261 - DNA, 18 bp, Artificial Sequence
  Synthetic Polynucleotide
aggcacttatcataagca

SEQ ID NO: 9262 - DNA, 18 bp, Artificial Sequence
  Synthetic Polynucleotide
actaggttgtggctatcg

SEQ ID NO: 9263 - DNA, 17 bp, Artificial Sequence
  Synthetic Polynucleotide
gcaatacgttcccaatc

SEQ ID NO: 9264 - DNA, 17 bp, Artificial Sequence
  Synthetic Polynucleotide
aaagaaatgctccaggt

SEQ ID NO: 9265 - DNA, 18 bp, Artificial Sequence
  Synthetic Polynucleotide
aaggtttgactgttggaa

SEQ ID NO: 9266 - DNA, 18 bp, Artificial Sequence
  Synthetic Polynucleotide
tacccaactgtattacct

SEQ ID NO: 9267 - DNA, 17 bp, Artificial Sequence
  Synthetic Polynucleotide
taatttgctcgtccaaa

SEQ ID NO: 9268 - DNA, 17 bp, Artificial Sequence
  Synthetic Polynucleotide
tcaggccgaagtactcc

SEQ ID NO: 9269 - DNA, 18 bp, Artificial Sequence
  Synthetic Polynucleotide
tctcccactcttgtttcg

SEQ ID NO: 9270 - DNA, 17 bp, Artificial Sequence
  Synthetic Polynucleotide
tatttgaccgctcctta

SEQ ID NO: 9271 - DNA, 18 bp, Artificial Sequence
  Synthetic Polynucleotide
tacacttcttgatcctca

SEQ ID NO: 9272 - DNA, 17 bp, Artificial Sequence
  Synthetic Polynucleotide
gcgttgcatacaatagg

SEQ ID NO: 9273 - DNA, 18 bp, Artificial Sequence
  Synthetic Polynucleotide
tgccaagtccatctcatc

SEQ ID NO: 9274 - DNA, 17 bp, Artificial Sequence
  Synthetic Polynucleotide
tctgggctaccaatatt

SEQ ID NO: 9275 - DNA, 17 bp, Artificial Sequence
  Synthetic Polynucleotide
gagggttttgaccttga

SEQ ID NO: 9276 - DNA, 17 bp, Artificial Sequence
  Synthetic Polynucleotide
ctggaaaatccttgctg

SEQ ID NO: 9277 - DNA, 17 bp, Artificial Sequence
  Synthetic Polynucleotide
tattgttggagttgctt

SEQ ID NO: 9278 - DNA, 17 bp, Artificial Sequence
  Synthetic Polynucleotide
ggacacatgatggtgat

SEQ ID NO: 9279 - DNA, 18 bp, Artificial Sequence
  Synthetic Polynucleotide
agttggacacatgatggt

SEQ ID NO: 9280 - DNA, 17 bp, Artificial Sequence
  Synthetic Polynucleotide
agcaggatctctggtct

SEQ ID NO: 9281 - DNA, 18 bp, Artificial Sequence
  Synthetic Polynucleotide
ggttagaggagacccctc

SEQ ID NO: 9282 - DNA, 18 bp, Artificial Sequence
  Synthetic Polynucleotide
tatcaggcagtaccacaa

SEQ ID NO: 9283 - DNA, 17 bp, Artificial Sequence
  Synthetic Polynucleotide
gagagccatagtggtct

SEQ ID NO: 9284 - DNA, 18 bp, Artificial Sequence
  Synthetic Polynucleotide
aggtgtcaatatgctgtt

SEQ ID NO: 9285 - DNA, 17 bp, Artificial Sequence
  Synthetic Polynucleotide
agaggttagaggagacc

SEQ ID NO: 9286 - DNA, 17 bp, Artificial Sequence
  Synthetic Polynucleotide
caactccatgtgccatg

SEQ ID NO: 9287 - DNA, 17 bp, Artificial Sequence
  Synthetic Polynucleotide
cctgagtacaggacagt

SEQ ID NO: 9288 - DNA, 17 bp, Artificial Sequence
  Synthetic Polynucleotide
ttcagtccaatcaagga

SEQ ID NO: 9289 - DNA, 18 bp, Artificial Sequence
  Synthetic Polynucleotide
gtgcgagctgtttcttag

SEQ ID NO: 9290 - DNA, 17 bp, Artificial Sequence
  Synthetic Polynucleotide
catgcccttagtaggac

SEQ ID NO: 9291 - DNA, 17 bp, Artificial Sequence
  Synthetic Polynucleotide
gggacagttgtattcca

SEQ ID NO: 9292 - DNA, 17 bp, Artificial Sequence
  Synthetic Polynucleotide
attgaggtgcattggtc

SEQ ID NO: 9293 - DNA, 18 bp, Artificial Sequence
  Synthetic Polynucleotide
agggagaacaagaaccgc

SEQ ID NO: 9294 - DNA, 18 bp, Artificial Sequence
  Synthetic Polynucleotide
gggaagagagaaattggc

SEQ ID NO: 9295 - DNA, 17 bp, Artificial Sequence
  Synthetic Polynucleotide
tcgacaagcgtgggtgg

SEQ ID NO: 9296 - DNA, 18 bp, Artificial Sequence
  Synthetic Polynucleotide
tcgtcgttaaaccgagcc

SEQ ID NO: 9297 - DNA, 17 bp, Artificial Sequence
  Synthetic Polynucleotide
ccattttctggcgttct

SEQ ID NO: 9298 - DNA, 18 bp, Artificial Sequence
  Synthetic Polynucleotide
ctgtgagccccgtccaag

SEQ ID NO: 9299 - DNA, 17 bp, Artificial Sequence
  Synthetic Polynucleotide
cctatcaggcagtacca

SEQ ID NO: 9300 - DNA, 17 bp, Artificial Sequence
  Synthetic Polynucleotide
cagaaagcgtctagcca

SEQ ID NO: 9301 - DNA, 18 bp, Artificial Sequence
  Synthetic Polynucleotide
tccctttcgagctaactc

SEQ ID NO: 9302 - DNA, 18 bp, Artificial Sequence
  Synthetic Polynucleotide
cgagtattcagtgcaaat

SEQ ID NO: 9303 - DNA, 17 bp, Artificial Sequence
  Synthetic Polynucleotide
atgatgagtcttgagcc

SEQ ID NO: 9304 - DNA, 18 bp, Artificial Sequence
  Synthetic Polynucleotide
tgagaaggaaaagttgca

SEQ ID NO: 9305 - DNA, 18 bp, Artificial Sequence
  Synthetic Polynucleotide
tttgtcatccaaaggtct

SEQ ID NO: 9306 - DNA, 18 bp, Artificial Sequence
  Synthetic Polynucleotide
gaggttagaggagaccct

SEQ ID NO: 9307 - DNA, 18 bp, Artificial Sequence
  Synthetic Polynucleotide
ggggaatttggtataggg

SEQ ID NO: 9308 - DNA, 18 bp, Artificial Sequence
  Synthetic Polynucleotide
tcaaagacagaatgtgag

SEQ ID NO: 9309 - DNA, 17 bp, Artificial Sequence
  Synthetic Polynucleotide
ccattgccgtacagacc

SEQ ID NO: 9310 - DNA, 17 bp, Artificial Sequence
  Synthetic Polynucleotide
aaggaaggcgtataccg

SEQ ID NO: 9311 - DNA, 17 bp, Artificial Sequence
  Synthetic Polynucleotide
gtgcttcatccatgatg

SEQ ID NO: 9312 - DNA, 18 bp, Artificial Sequence
  Synthetic Polynucleotide
acggaaaagtgcaggtga

SEQ ID NO: 9313 - DNA, 17 bp, Artificial Sequence
  Synthetic Polynucleotide
cagttcaatagcccagg

SEQ ID NO: 9314 - DNA, 17 bp, Artificial Sequence
  Synthetic Polynucleotide
gaaagcgagcccctaac

SEQ ID NO: 9315 - DNA, 18 bp, Artificial Sequence
  Synthetic Polynucleotide
gaatgttgagcaagccct

SEQ ID NO: 9316 - DNA, 18 bp, Artificial Sequence
  Synthetic Polynucleotide
ctctaaaaggcccgtctg

SEQ ID NO: 9317 - DNA, 18 bp, Artificial Sequence
  Synthetic Polynucleotide
tagatgaatcccaggaag

SEQ ID NO: 9318 - DNA, 17 bp, Artificial Sequence
  Synthetic Polynucleotide
ccctcgtcacacaagat

SEQ ID NO: 9319 - DNA, 17 bp, Artificial Sequence
  Synthetic Polynucleotide
gtgtgaatggtgtgatg

SEQ ID NO: 9320 - DNA, 17 bp, Artificial Sequence
  Synthetic Polynucleotide
gcagaagtacccgtatg

SEQ ID NO: 9321 - DNA, 17 bp, Artificial Sequence
  Synthetic Polynucleotide
ggtagagttaaggtggg

SEQ ID NO: 9322 - DNA, 18 bp, Artificial Sequence
  Synthetic Polynucleotide
tccagtagcagtccaact

SEQ ID NO: 9323 - DNA, 18 bp, Artificial Sequence
  Synthetic Polynucleotide
cagcttaggagaacaaga

SEQ ID NO: 9324 - DNA, 17 bp, Artificial Sequence
  Synthetic Polynucleotide
tccatccaaaacatgcc

SEQ ID NO: 9325 - DNA, 17 bp, Artificial Sequence
  Synthetic Polynucleotide
tctgacaaggttatccg

SEQ ID NO: 9326 - DNA, 17 bp, Artificial Sequence
  Synthetic Polynucleotide
tcagtgcgtatggtgat

SEQ ID NO: 9327 - DNA, 18 bp, Artificial Sequence
  Synthetic Polynucleotide
cgtcaatatgctaaagcg

SEQ ID NO: 9328 - DNA, 17 bp, Artificial Sequence
  Synthetic Polynucleotide
aaggtgagaatcaagga

SEQ ID NO: 9329 - DNA, 18 bp, Artificial Sequence
  Synthetic Polynucleotide
agaggttagaggagaccc

SEQ ID NO: 9330 - DNA, 18 bp, Artificial Sequence
  Synthetic Polynucleotide
accatcagagtgaacatt

SEQ ID NO: 9331 - DNA, 17 bp, Artificial Sequence
  Synthetic Polynucleotide
ccccatttcattggccg

SEQ ID NO: 9332 - DNA, 17 bp, Artificial Sequence
  Synthetic Polynucleotide
ccatccaggacaaccag

SEQ ID NO: 9333 - DNA, 18 bp, Artificial Sequence
  Synthetic Polynucleotide
cgtttccaatcgtgatca

SEQ ID NO: 9334 - DNA, 17 bp, Artificial Sequence
  Synthetic Polynucleotide
gggaaccaagaaggatc

SEQ ID NO: 9335 - DNA, 18 bp, Artificial Sequence
  Synthetic Polynucleotide
tgtcgtaacaagcaggaa

SEQ ID NO: 9336 - DNA, 17 bp, Artificial Sequence
  Synthetic Polynucleotide
ggtatatccatcaggcc

SEQ ID NO: 9337 - DNA, 17 bp, Artificial Sequence
  Synthetic Polynucleotide
agagagcgtccatcttt

SEQ ID NO: 9338 - DNA, 18 bp, Artificial Sequence
  Synthetic Polynucleotide
caggtgaggtaaaagtgg

SEQ ID NO: 9339 - DNA, 18 bp, Artificial Sequence
  Synthetic Polynucleotide
cttctttcgtcaaccgat

SEQ ID NO: 9340 - DNA, 17 bp, Artificial Sequence
  Synthetic Polynucleotide
ccgtgatgcagaagaag

SEQ ID NO: 9341 - DNA, 17 bp, Artificial Sequence
  Synthetic Polynucleotide
ccattgagcgaacaaga

SEQ ID NO: 9342 - DNA, 18 bp, Artificial Sequence
  Synthetic Polynucleotide
gtatgcagaacaggtgaa

SEQ ID NO: 9343 - DNA, 17 bp, Artificial Sequence
  Synthetic Polynucleotide
gcgtgcgatgtgtcatt

SEQ ID NO: 9344 - DNA, 18 bp, Artificial Sequence
  Synthetic Polynucleotide
tgaatgtgaggtgtcaaa

SEQ ID NO: 9345 - DNA, 17 bp, Artificial Sequence
  Synthetic Polynucleotide
caatcccgtgatcattg

SEQ ID NO: 9346 - DNA, 17 bp, Artificial Sequence
  Synthetic Polynucleotide
gaggatctggtcaagtt

SEQ ID NO: 9347 - DNA, 18 bp, Artificial Sequence
  Synthetic Polynucleotide
taaagtccacagttaggt

SEQ ID NO: 9348 - DNA, 18 bp, Artificial Sequence
  Synthetic Polynucleotide
aggtagaattgagatgcc

SEQ ID NO: 9349 - DNA, 18 bp, Artificial Sequence
  Synthetic Polynucleotide
ggatgtttcatagcgtac

SEQ ID NO: 9350 - DNA, 18 bp, Artificial Sequence
  Synthetic Polynucleotide
agctgttaaggagcccga

SEQ ID NO: 9351 - DNA, 17 bp, Artificial Sequence
  Synthetic Polynucleotide
tgagtcattaaaggccg

SEQ ID NO: 9352 - DNA, 17 bp, Artificial Sequence
  Synthetic Polynucleotide
ccagtgaacacaaggtc

SEQ ID NO: 9353 - DNA, 18 bp, Artificial Sequence
  Synthetic Polynucleotide
atcgtgaattgagtttcc

SEQ ID NO: 9354 - DNA, 18 bp, Artificial Sequence
  Synthetic Polynucleotide
atcaggaggaacttatgg

SEQ ID NO: 9355 - DNA, 18 bp, Artificial Sequence
  Synthetic Polynucleotide
cctagaataatttggcgc

SEQ ID NO: 9356 - DNA, 17 bp, Artificial Sequence
  Synthetic Polynucleotide
ttctcatgtcaacgtgg

SEQ ID NO: 9357 - DNA, 18 bp, Artificial Sequence
  Synthetic Polynucleotide
cagtttatgcccgtagaa

SEQ ID NO: 9358 - DNA, 17 bp, Artificial Sequence
  Synthetic Polynucleotide
acaagtgaagtcggagg

SEQ ID NO: 9359 - DNA, 18 bp, Artificial Sequence
  Synthetic Polynucleotide
ctgtcaatcccgaagtcc

SEQ ID NO: 9360 - DNA, 17 bp, Artificial Sequence
  Synthetic Polynucleotide
gtcatatccaggaccga

SEQ ID NO: 9361 - DNA, 17 bp, Artificial Sequence
  Synthetic Polynucleotide
gctttgaggtatggtgt

SEQ ID NO: 9362 - DNA, 17 bp, Artificial Sequence
  Synthetic Polynucleotide
gagtccaacaatgaagc

SEQ ID NO: 9363 - DNA, 18 bp, Artificial Sequence
  Synthetic Polynucleotide
atgggtcatccatctata

SEQ ID NO: 9364 - DNA, 17 bp, Artificial Sequence
  Synthetic Polynucleotide
ctcttcgggtacatcgc

SEQ ID NO: 9365 - DNA, 17 bp, Artificial Sequence
  Synthetic Polynucleotide
tctgagaagcaggtggt

SEQ ID NO: 9366 - DNA, 17 bp, Artificial Sequence
  Synthetic Polynucleotide
cacaactgcaagaagcc

SEQ ID NO: 9367 - DNA, 17 bp, Artificial Sequence
  Synthetic Polynucleotide
acccagccttgaaatcg

SEQ ID NO: 9368 - DNA, 17 bp, Artificial Sequence
  Synthetic Polynucleotide
ggccaagaaaggattta

SEQ ID NO: 9369 - DNA, 18 bp, Artificial Sequence
  Synthetic Polynucleotide
tgagactttaccgctgtg

SEQ ID NO: 9370 - DNA, 18 bp, Artificial Sequence
  Synthetic Polynucleotide
tccaaattaagctcactg

SEQ ID NO: 9371 - DNA, 17 bp, Artificial Sequence
  Synthetic Polynucleotide
ttgaacaagaaggtgct

SEQ ID NO: 9372 - DNA, 17 bp, Artificial Sequence
  Synthetic Polynucleotide
gactatgaagccttcga

SEQ ID NO: 9373 - DNA, 18 bp, Artificial Sequence
  Synthetic Polynucleotide
gcagccaaacaactagag

SEQ ID NO: 9374 - DNA, 17 bp, Artificial Sequence
  Synthetic Polynucleotide
tgtgtcctgatgccact

SEQ ID NO: 9375 - DNA, 17 bp, Artificial Sequence
  Synthetic Polynucleotide
acagagtccgtgtaaac

SEQ ID NO: 9376 - DNA, 17 bp, Artificial Sequence
  Synthetic Polynucleotide
tagccaaaccgacgttc

SEQ ID NO: 9377 - DNA, 18 bp, Artificial Sequence
  Synthetic Polynucleotide
ggctagaaattgaaaccc

SEQ ID NO: 9378 - DNA, 17 bp, Artificial Sequence
  Synthetic Polynucleotide
atcgtccgcaatcatcg

SEQ ID NO: 9379 - DNA, 17 bp, Artificial Sequence
  Synthetic Polynucleotide
gaagtgcctgtgcaact

SEQ ID NO: 9380 - DNA, 18 bp, Artificial Sequence
  Synthetic Polynucleotide
gttgctgagaactacgct

SEQ ID NO: 9381 - DNA, 18 bp, Artificial Sequence
  Synthetic Polynucleotide
tctcctgaacctactaag

SEQ ID NO: 9382 - DNA, 17 bp, Artificial Sequence
  Synthetic Polynucleotide
ctgccagagtgactatg

SEQ ID NO: 9383 - DNA, 18 bp, Artificial Sequence
  Synthetic Polynucleotide
accgtcagaagttccttt

SEQ ID NO: 9384 - DNA, 18 bp, Artificial Sequence
  Synthetic Polynucleotide
agagaggatttaggtccc

SEQ ID NO: 9385 - DNA, 17 bp, Artificial Sequence
  Synthetic Polynucleotide
gcccattcccctttgat

SEQ ID NO: 9386 - DNA, 17 bp, Artificial Sequence
  Synthetic Polynucleotide
tacgccaatgactacac

SEQ ID NO: 9387 - DNA, 17 bp, Artificial Sequence
  Synthetic Polynucleotide
acgtccagaaccctgta

SEQ ID NO: 9388 - DNA, 17 bp, Artificial Sequence
  Synthetic Polynucleotide
acgtgccgacatacttg

SEQ ID NO: 9389 - DNA, 18 bp, Artificial Sequence
  Synthetic Polynucleotide
agtgatccgttgatgagt

SEQ ID NO: 9390 - DNA, 18 bp, Artificial Sequence
  Synthetic Polynucleotide
agcttttccaacatcaac

SEQ ID NO: 9391 - DNA, 17 bp, Artificial Sequence
  Synthetic Polynucleotide
ctgcaatcgcttagaag

SEQ ID NO: 9392 - DNA, 17 bp, Artificial Sequence
  Synthetic Polynucleotide
gcctcccaagatcaata

SEQ ID NO: 9393 - DNA, 17 bp, Artificial Sequence
  Synthetic Polynucleotide
agccactatccaggttg

SEQ ID NO: 9394 - DNA, 18 bp, Artificial Sequence
  Synthetic Polynucleotide
cgcctacaaattaggtga

SEQ ID NO: 9395 - DNA, 17 bp, Artificial Sequence
  Synthetic Polynucleotide
ggtgccatagagcatga

SEQ ID NO: 9396 - DNA, 18 bp, Artificial Sequence
  Synthetic Polynucleotide
aaagagcagccagatttc

SEQ ID NO: 9397 - DNA, 17 bp, Artificial Sequence
  Synthetic Polynucleotide
tgctcctccagaaattt

SEQ ID NO: 9398 - DNA, 17 bp, Artificial Sequence
  Synthetic Polynucleotide
actttcgacgcaaacac

SEQ ID NO: 9399 - DNA, 18 bp, Artificial Sequence
  Synthetic Polynucleotide
tattccatgaggtgtgag

SEQ ID NO: 9400 - DNA, 17 bp, Artificial Sequence
  Synthetic Polynucleotide
acacatccgactacaca

SEQ ID NO: 9401 - DNA, 17 bp, Artificial Sequence
  Synthetic Polynucleotide
tccagagccctgtaaac

SEQ ID NO: 9402 - DNA, 17 bp, Artificial Sequence
  Synthetic Polynucleotide
ggtctttccgcaaatca

SEQ ID NO: 9403 - DNA, 17 bp, Artificial Sequence
  Synthetic Polynucleotide
cccaacttagagcccaa

SEQ ID NO: 9404 - DNA, 17 bp, Artificial Sequence
  Synthetic Polynucleotide
tcacaagacgcctatat

SEQ ID NO: 9405 - DNA, 17 bp, Artificial Sequence
  Synthetic Polynucleotide
tcaagtttctcccagaa

SEQ ID NO: 9406 - DNA, 17 bp, Artificial Sequence
  Synthetic Polynucleotide
gccagagaagatcaaga

SEQ ID NO: 9407 - DNA, 18 bp, Artificial Sequence
  Synthetic Polynucleotide
ctctaaacttccccaagg

SEQ ID NO: 9408 - DNA, 17 bp, Artificial Sequence
  Synthetic Polynucleotide
cgaacagtcctgaaaac

SEQ ID NO: 9409 - DNA, 18 bp, Artificial Sequence
  Synthetic Polynucleotide
ttcattaagtccgtcagc

SEQ ID NO: 9410 - DNA, 17 bp, Artificial Sequence
  Synthetic Polynucleotide
tttcccacttttcgaga

SEQ ID NO: 9411 - DNA, 18 bp, Artificial Sequence
  Synthetic Polynucleotide
caagaaaggtatgcaacc

SEQ ID NO: 9412 - DNA, 17 bp, Artificial Sequence
  Synthetic Polynucleotide
tttcgctttgagaacct

SEQ ID NO: 9413 - DNA, 17 bp, Artificial Sequence
  Synthetic Polynucleotide
tttctgaagtcccagtg

SEQ ID NO: 9414 - DNA, 17 bp, Artificial Sequence
  Synthetic Polynucleotide
gttattatccagccgca

SEQ ID NO: 9415 - DNA, 18 bp, Artificial Sequence
  Synthetic Polynucleotide
ggccagactatcgcatcc

SEQ ID NO: 9416 - DNA, 18 bp, Artificial Sequence
  Synthetic Polynucleotide
accctatagccagtcttc

SEQ ID NO: 9417 - DNA, 18 bp, Artificial Sequence
  Synthetic Polynucleotide
tggtggtgatgaatgata

SEQ ID NO: 9418 - DNA, 17 bp, Artificial Sequence
  Synthetic Polynucleotide
gttttctcgtccctgta

SEQ ID NO: 9419 - DNA, 18 bp, Artificial Sequence
  Synthetic Polynucleotide
tttggtgccatctactat

SEQ ID NO: 9420 - DNA, 18 bp, Artificial Sequence
  Synthetic Polynucleotide
atagcccattcgacgttc

SEQ ID NO: 9421 - DNA, 18 bp, Artificial Sequence
  Synthetic Polynucleotide
cccagaatgcaagatcaa

SEQ ID NO: 9422 - DNA, 17 bp, Artificial Sequence
  Synthetic Polynucleotide
gtgccatagagcatgac

SEQ ID NO: 9423 - DNA, 18 bp, Artificial Sequence
  Synthetic Polynucleotide
cgactccaacaagattca

SEQ ID NO: 9424 - DNA, 17 bp, Artificial Sequence
  Synthetic Polynucleotide
cagtgcccttatgcctg

SEQ ID NO: 9425 - DNA, 18 bp, Artificial Sequence
  Synthetic Polynucleotide
catcccaatcatgagtct

SEQ ID NO: 9426 - DNA, 18 bp, Artificial Sequence
  Synthetic Polynucleotide
gggtcaattccgtgatgg

SEQ ID NO: 9427 - DNA, 18 bp, Artificial Sequence
  Synthetic Polynucleotide
gccctcgttaattgcccc

SEQ ID NO: 9428 - DNA, 17 bp, Artificial Sequence
  Synthetic Polynucleotide
cgtgcaagaactacatg

SEQ ID NO: 9429 - DNA, 17 bp, Artificial Sequence
  Synthetic Polynucleotide
agccacaatcgcaaatc

SEQ ID NO: 9430 - DNA, 18 bp, Artificial Sequence
  Synthetic Polynucleotide
attgccaagagttcactg

SEQ ID NO: 9431 - DNA, 17 bp, Artificial Sequence
  Synthetic Polynucleotide
tctcaactgtccttgag

SEQ ID NO: 9432 - DNA, 17 bp, Artificial Sequence
  Synthetic Polynucleotide
ccatcttagccagtgtg

SEQ ID NO: 9433 - DNA, 17 bp, Artificial Sequence
  Synthetic Polynucleotide
ggtcaagcaagttaccg

SEQ ID NO: 9434 - DNA, 18 bp, Artificial Sequence
  Synthetic Polynucleotide
ttaattcgcccagcccct

SEQ ID NO: 9435 - DNA, 17 bp, Artificial Sequence
  Synthetic Polynucleotide
cagattcgccccatata

SEQ ID NO: 9436 - DNA, 18 bp, Artificial Sequence
  Synthetic Polynucleotide
ttccagttagaaccatga

SEQ ID NO: 9437 - DNA, 18 bp, Artificial Sequence
  Synthetic Polynucleotide
ttgattatcgccttgagc

SEQ ID NO: 9438 - DNA, 18 bp, Artificial Sequence
  Synthetic Polynucleotide
gattcttttagtgccgtc

SEQ ID NO: 9439 - DNA, 18 bp, Artificial Sequence
  Synthetic Polynucleotide
cgtgtgccaattcttcga

SEQ ID NO: 9440 - DNA, 18 bp, Artificial Sequence
  Synthetic Polynucleotide
tcttgaagccgtcatacg

SEQ ID NO: 9441 - DNA, 17 bp, Artificial Sequence
  Synthetic Polynucleotide
ccagtcaagcccctagc

SEQ ID NO: 9442 - DNA, 18 bp, Artificial Sequence
  Synthetic Polynucleotide
tcagattttagcaagtgc

SEQ ID NO: 9443 - DNA, 18 bp, Artificial Sequence
  Synthetic Polynucleotide
tgctattcactttcctga

SEQ ID NO: 9444 - DNA, 18 bp, Artificial Sequence
  Synthetic Polynucleotide
gtgtctcttttccagttc

SEQ ID NO: 9445 - DNA, 17 bp, Artificial Sequence
  Synthetic Polynucleotide
ggccaaccagaattcgc

SEQ ID NO: 9446 - DNA, 18 bp, Artificial Sequence
  Synthetic Polynucleotide
ggtgacaaaacattcctc

SEQ ID NO: 9447 - DNA, 17 bp, Artificial Sequence
  Synthetic Polynucleotide
taaattcccaaacgccg

SEQ ID NO: 9448 - DNA, 17 bp, Artificial Sequence
  Synthetic Polynucleotide
cgtctctatctccgcta

SEQ ID NO: 9449 - DNA, 18 bp, Artificial Sequence
  Synthetic Polynucleotide
tagccacaaacccttaca

SEQ ID NO: 9450 - DNA, 17 bp, Artificial Sequence
  Synthetic Polynucleotide
tgccccagccaaaattg

SEQ ID NO: 9451 - DNA, 18 bp, Artificial Sequence
  Synthetic Polynucleotide
accaatgataatgccgca

SEQ ID NO: 9452 - DNA, 18 bp, Artificial Sequence
  Synthetic Polynucleotide
attgcccaactttgaacc

SEQ ID NO: 9453 - DNA, 17 bp, Artificial Sequence
  Synthetic Polynucleotide
gttccgcaagcatgtgc

SEQ ID NO: 9454 - DNA, 17 bp, Artificial Sequence
  Synthetic Polynucleotide
ccagctattacgcaaac

SEQ ID NO: 9455 - DNA, 18 bp, Artificial Sequence
  Synthetic Polynucleotide
tcacaacaagagtttctc

SEQ ID NO: 9456 - DNA, 17 bp, Artificial Sequence
  Synthetic Polynucleotide
gactccccaaatgtcat

SEQ ID NO: 9457 - DNA, 17 bp, Artificial Sequence
  Synthetic Polynucleotide
aaagatatgccgtcagc

SEQ ID NO: 9458 - DNA, 18 bp, Artificial Sequence
  Synthetic Polynucleotide
atgtctaggtagccctcg

SEQ ID NO: 9459 - DNA, 17 bp, Artificial Sequence
  Synthetic Polynucleotide
ctccaaaccctcctacg

SEQ ID NO: 9460 - DNA, 18 bp, Artificial Sequence
  Synthetic Polynucleotide
atgttccagtccctcctt

SEQ ID NO: 9461 - DNA, 18 bp, Artificial Sequence
  Synthetic Polynucleotide
ccacttccccattaggaa

SEQ ID NO: 9462 - DNA, 17 bp, Artificial Sequence
  Synthetic Polynucleotide
ataaccgctccgatcta

SEQ ID NO: 9463 - DNA, 18 bp, Artificial Sequence
  Synthetic Polynucleotide
gaaggtcaagaaaggtgc

SEQ ID NO: 9464 - DNA, 17 bp, Artificial Sequence
  Synthetic Polynucleotide
acgaaccagttccacaa

SEQ ID NO: 9465 - DNA, 17 bp, Artificial Sequence
  Synthetic Polynucleotide
attagtcccagccattg

SEQ ID NO: 9466 - DNA, 17 bp, Artificial Sequence
  Synthetic Polynucleotide
gccatcgtccataagat

SEQ ID NO: 9467 - DNA, 17 bp, Artificial Sequence
  Synthetic Polynucleotide
acttttcgcccacaacc

SEQ ID NO: 9468 - DNA, 18 bp, Artificial Sequence
  Synthetic Polynucleotide
atttcccagagccgccgg

SEQ ID NO: 9469 - DNA, 18 bp, Artificial Sequence
  Synthetic Polynucleotide
tctcccttacattccgct

SEQ ID NO: 9470 - DNA, 18 bp, Artificial Sequence
  Synthetic Polynucleotide
tccatccccaatgtcatc

SEQ ID NO: 9471 - DNA, 17 bp, Artificial Sequence
  Synthetic Polynucleotide
agccatcttttgagagg

SEQ ID NO: 9472 - DNA, 18 bp, Artificial Sequence
  Synthetic Polynucleotide
gcaatgagtccataaacg

SEQ ID NO: 9473 - DNA, 18 bp, Artificial Sequence
  Synthetic Polynucleotide
ctactgaacccctcgtta

SEQ ID NO: 9474 - DNA, 18 bp, Artificial Sequence
  Synthetic Polynucleotide
aatccaacccttccaata

SEQ ID NO: 9475 - DNA, 18 bp, Artificial Sequence
  Synthetic Polynucleotide
agagatttccaatcgcat

SEQ ID NO: 9476 - DNA, 18 bp, Artificial Sequence
  Synthetic Polynucleotide
gtttccacaagttcacat

SEQ ID NO: 9477 - DNA, 18 bp, Artificial Sequence
  Synthetic Polynucleotide
gctatgaaaatgccatca

SEQ ID NO: 9478 - DNA, 17 bp, Artificial Sequence
  Synthetic Polynucleotide
tgtgtcccaactccccg

SEQ ID NO: 9479 - DNA, 17 bp, Artificial Sequence
  Synthetic Polynucleotide
ggtacgcaaactgccac

SEQ ID NO: 9480 - DNA, 18 bp, Artificial Sequence
  Synthetic Polynucleotide
tggtcctacaagttccac

SEQ ID NO: 9481 - DNA, 18 bp, Artificial Sequence
  Synthetic Polynucleotide
gaacgctaataagccaat

SEQ ID NO: 9482 - DNA, 17 bp, Artificial Sequence
  Synthetic Polynucleotide
gccgtatcccaaactat

SEQ ID NO: 9483 - DNA, 18 bp, Artificial Sequence
  Synthetic Polynucleotide
ccgcaagagaataagtgc

SEQ ID NO: 9484 - DNA, 18 bp, Artificial Sequence
  Synthetic Polynucleotide
gtaactgtactcctcccc

SEQ ID NO: 9485 - DNA, 18 bp, Artificial Sequence
  Synthetic Polynucleotide
cttcaactttgccctcct

SEQ ID NO: 9486 - DNA, 17 bp, Artificial Sequence
  Synthetic Polynucleotide
tatggcgattgaaccgt

SEQ ID NO: 9487 - DNA, 17 bp, Artificial Sequence
  Synthetic Polynucleotide
tcatcatcacaaatcgc

SEQ ID NO: 9488 - DNA, 17 bp, Artificial Sequence
  Synthetic Polynucleotide
gccttatgccaaaccag

SEQ ID NO: 9489 - DNA, 18 bp, Artificial Sequence
  Synthetic Polynucleotide
aagaggcactaaaagtga

SEQ ID NO: 9490 - DNA, 18 bp, Artificial Sequence
  Synthetic Polynucleotide
tatctcagcactgcaaat

SEQ ID NO: 9491 - DNA, 17 bp, Artificial Sequence
  Synthetic Polynucleotide
gtcaggtcaaggggaac

SEQ ID NO: 9492 - DNA, 17 bp, Artificial Sequence
  Synthetic Polynucleotide
tattgtctccagtctcc

SEQ ID NO: 9493 - DNA, 17 bp, Artificial Sequence
  Synthetic Polynucleotide
acatagcctccccttta

SEQ ID NO: 9494 - DNA, 17 bp, Artificial Sequence
  Synthetic Polynucleotide
gcatgtatcactcccga

SEQ ID NO: 9495 - DNA, 17 bp, Artificial Sequence
  Synthetic Polynucleotide
gtgacgtatccttccag

SEQ ID NO: 9496 - DNA, 18 bp, Artificial Sequence
  Synthetic Polynucleotide
atcctgtccaaacagttc

SEQ ID NO: 9497 - DNA, 18 bp, Artificial Sequence
  Synthetic Polynucleotide
gtatgcctgttcctagcc

SEQ ID NO: 9498 - DNA, 18 bp, Artificial Sequence
  Synthetic Polynucleotide
acaatcttcctctgcaat

SEQ ID NO: 9499 - DNA, 18 bp, Artificial Sequence
  Synthetic Polynucleotide
gtgcgtaaatccatcttc

SEQ ID NO: 9500 - DNA, 18 bp, Artificial Sequence
  Synthetic Polynucleotide
tacatcctatgtcccgtt

SEQ ID NO: 9501 - DNA, 17 bp, Artificial Sequence
  Synthetic Polynucleotide
tccgttgatatcccttt

SEQ ID NO: 9502 - DNA, 17 bp, Artificial Sequence
  Synthetic Polynucleotide
cgaccgttgtattccga

SEQ ID NO: 9503 - DNA, 18 bp, Artificial Sequence
  Synthetic Polynucleotide
tgcaatttccttctgcgg

SEQ ID NO: 9504 - DNA, 18 bp, Artificial Sequence
  Synthetic Polynucleotide
ttctctacctctgactcg

SEQ ID NO: 9505 - DNA, 18 bp, Artificial Sequence
  Synthetic Polynucleotide
tattttcctttcccacct

SEQ ID NO: 9506 - DNA, 18 bp, Artificial Sequence
  Synthetic Polynucleotide
agctcttccttagtctta

SEQ ID NO: 9507 - DNA, 18 bp, Artificial Sequence
  Synthetic Polynucleotide
tgtcgtgaatctccacta

SEQ ID NO: 9508 - DNA, 17 bp, Artificial Sequence
  Synthetic Polynucleotide
tcaacacatttccatcc

SEQ ID NO: 9509 - DNA, 18 bp, Artificial Sequence
  Synthetic Polynucleotide
aatgacgttgtaccaagc

SEQ ID NO: 9510 - DNA, 18 bp, Artificial Sequence
  Synthetic Polynucleotide
tccgacatccaacaataa

SEQ ID NO: 9511 - DNA, 17 bp, Artificial Sequence
  Synthetic Polynucleotide
gtcaatcatcccagctt

SEQ ID NO: 9512 - DNA, 18 bp, Artificial Sequence
  Synthetic Polynucleotide
aacacttctatcccgtct

SEQ ID NO: 9513 - DNA, 17 bp, Artificial Sequence
  Synthetic Polynucleotide
cagaaaccccagacatt

SEQ ID NO: 9514 - DNA, 17 bp, Artificial Sequence
  Synthetic Polynucleotide
cttcagccgaacctgca

SEQ ID NO: 9515 - DNA, 17 bp, Artificial Sequence
  Synthetic Polynucleotide
gtccaaatccgtaatgc

SEQ ID NO: 9516 - DNA, 18 bp, Artificial Sequence
  Synthetic Polynucleotide
tcgatgtaatctccgtcc

SEQ ID NO: 9517 - DNA, 17 bp, Artificial Sequence
  Synthetic Polynucleotide
ttcttccactccgtttt

SEQ ID NO: 9518 - DNA, 17 bp, Artificial Sequence
  Synthetic Polynucleotide
cagcctgcaagtattcc

SEQ ID NO: 9519 - DNA, 18 bp, Artificial Sequence
  Synthetic Polynucleotide
cgttgatatccctttccg

SEQ ID NO: 9520 - DNA, 17 bp, Artificial Sequence
  Synthetic Polynucleotide
actgagtcctctctgcc

SEQ ID NO: 9521 - DNA, 18 bp, Artificial Sequence
  Synthetic Polynucleotide
gcctttcttcttcagatg

SEQ ID NO: 9522 - DNA, 18 bp, Artificial Sequence
  Synthetic Polynucleotide
cctctcccatttcccgta

SEQ ID NO: 9523 - DNA, 18 bp, Artificial Sequence
  Synthetic Polynucleotide
caggtccagttcaactac

SEQ ID NO: 9524 - DNA, 17 bp, Artificial Sequence
  Synthetic Polynucleotide
cctctaaccccgtgtat

SEQ ID NO: 9525 - DNA, 18 bp, Artificial Sequence
  Synthetic Polynucleotide
aatcccgtccatcattct

SEQ ID NO: 9526 - DNA, 17 bp, Artificial Sequence
  Synthetic Polynucleotide
tgtgtgccaatacccgg

SEQ ID NO: 9527 - DNA, 18 bp, Artificial Sequence
  Synthetic Polynucleotide
gttccaaatcccctctat

SEQ ID NO: 9528 - DNA, 18 bp, Artificial Sequence
  Synthetic Polynucleotide
agaccgataacccctaat

SEQ ID NO: 9529 - DNA, 18 bp, Artificial Sequence
  Synthetic Polynucleotide
gtccactcaaccgtttca

SEQ ID NO: 9530 - DNA, 18 bp, Artificial Sequence
  Synthetic Polynucleotide
gtcctctctctcaatccc

SEQ ID NO: 9531 - DNA, 18 bp, Artificial Sequence
  Synthetic Polynucleotide
cattcccttcaagttctg

SEQ ID NO: 9532 - DNA, 18 bp, Artificial Sequence
  Synthetic Polynucleotide
ttctctcctgcctgcatt

SEQ ID NO: 9533 - DNA, 18 bp, Artificial Sequence
  Synthetic Polynucleotide
ccaatcagatgcaacata

SEQ ID NO: 9534 - DNA, 18 bp, Artificial Sequence
  Synthetic Polynucleotide
tctttcccatctcccgta

SEQ ID NO: 9535 - DNA, 18 bp, Artificial Sequence
  Synthetic Polynucleotide
gtactccttctgaaccta

SEQ ID NO: 9536 - DNA, 17 bp, Artificial Sequence
  Synthetic Polynucleotide
tggcgataaccccttct

SEQ ID NO: 9537 - DNA, 17 bp, Artificial Sequence
  Synthetic Polynucleotide
ccacatacttctccgtt

SEQ ID NO: 9538 - DNA, 18 bp, Artificial Sequence
  Synthetic Polynucleotide
gaaccgtctactagtctc

SEQ ID NO: 9539 - DNA, 17 bp, Artificial Sequence
  Synthetic Polynucleotide
tcagcctgtacatcctc

SEQ ID NO: 9540 - DNA, 17 bp, Artificial Sequence
  Synthetic Polynucleotide
gtcatgtctctcaacca

SEQ ID NO: 9541 - DNA, 18 bp, Artificial Sequence
  Synthetic Polynucleotide
cgtatcagacatccaaca

SEQ ID NO: 9542 - DNA, 17 bp, Artificial Sequence
  Synthetic Polynucleotide
gactctacccaatcgta

SEQ ID NO: 9543 - DNA, 18 bp, Artificial Sequence
  Synthetic Polynucleotide
gcaaaccgttcattcagg

SEQ ID NO: 9544 - DNA, 18 bp, Artificial Sequence
  Synthetic Polynucleotide
tctcaaatttctccactg

SEQ ID NO: 9545 - DNA, 17 bp, Artificial Sequence
  Synthetic Polynucleotide
tccgaacattcagcgag

SEQ ID NO: 9546 - DNA, 18 bp, Artificial Sequence
  Synthetic Polynucleotide
tgtttacctcctctagct

SEQ ID NO: 9547 - DNA, 17 bp, Artificial Sequence
  Synthetic Polynucleotide
atgcacccctatagaga

SEQ ID NO: 9548 - DNA, 18 bp, Artificial Sequence
  Synthetic Polynucleotide
gcacatccctttctaaca

SEQ ID NO: 9549 - DNA, 18 bp, Artificial Sequence
  Synthetic Polynucleotide
ccttaaagacccaattcc

SEQ ID NO: 9550 - DNA, 18 bp, Artificial Sequence
  Synthetic Polynucleotide
tcttcagtttccccttaa

SEQ ID NO: 9551 - DNA, 17 bp, Artificial Sequence
  Synthetic Polynucleotide
cgctcctcccattacag

SEQ ID NO: 9552 - DNA, 17 bp, Artificial Sequence
  Synthetic Polynucleotide
aatgctccaaatgcgtt

SEQ ID NO: 9553 - DNA, 17 bp, Artificial Sequence
  Synthetic Polynucleotide
cttccgtagtccacatg

SEQ ID NO: 9554 - DNA, 17 bp, Artificial Sequence
  Synthetic Polynucleotide
tcaacccaaccccgtcg

SEQ ID NO: 9555 - DNA, 18 bp, Artificial Sequence
  Synthetic Polynucleotide
attctaggtcctgcctcg

SEQ ID NO: 9556 - DNA, 17 bp, Artificial Sequence
  Synthetic Polynucleotide
ggccaccttccaagtag

SEQ ID NO: 9557 - DNA, 17 bp, Artificial Sequence
  Synthetic Polynucleotide
ccctcttcttcctccgc

SEQ ID NO: 9558 - DNA, 18 bp, Artificial Sequence
  Synthetic Polynucleotide
gctagttaatcctccgag

SEQ ID NO: 9559 - DNA, 18 bp, Artificial Sequence
  Synthetic Polynucleotide
tctttaacccaacccttg

SEQ ID NO: 9560 - DNA, 18 bp, Artificial Sequence
  Synthetic Polynucleotide
ggcgtctcaattaagcgc

SEQ ID NO: 9561 - DNA, 18 bp, Artificial Sequence
  Synthetic Polynucleotide
atcatcttcctttcccat

SEQ ID NO: 9562 - DNA, 17 bp, Artificial Sequence
  Synthetic Polynucleotide
ctcgaccactaatgaca

SEQ ID NO: 9563 - DNA, 17 bp, Artificial Sequence
  Synthetic Polynucleotide
ccttccaagtcaaccat

SEQ ID NO: 9564 - DNA, 18 bp, Artificial Sequence
  Synthetic Polynucleotide
gcttaccgtctagttcat

SEQ ID NO: 9565 - DNA, 18 bp, Artificial Sequence
  Synthetic Polynucleotide
gcactcctccctttattt

SEQ ID NO: 9566 - DNA, 18 bp, Artificial Sequence
  Synthetic Polynucleotide
taatgacgtttaacagct

SEQ ID NO: 9567 - DNA, 18 bp, Artificial Sequence
  Synthetic Polynucleotide
acatacccattgtccaat

SEQ ID NO: 9568 - DNA, 17 bp, Artificial Sequence
  Synthetic Polynucleotide
ggccaaatagctccgag

SEQ ID NO: 9569 - DNA, 18 bp, Artificial Sequence
  Synthetic Polynucleotide
cctttgttcaataccccg

SEQ ID NO: 9570 - DNA, 17 bp, Artificial Sequence
  Synthetic Polynucleotide
gtgcttgttgaatcacc

SEQ ID NO: 9571 - DNA, 18 bp, Artificial Sequence
  Synthetic Polynucleotide
aggggcgttgacatcacg

SEQ ID NO: 9572 - DNA, 17 bp, Artificial Sequence
  Synthetic Polynucleotide
acccacatgcggtatat

SEQ ID NO: 9573 - DNA, 18 bp, Artificial Sequence
  Synthetic Polynucleotide
ccagcactaaatgcgtac

SEQ ID NO: 9574 - DNA, 17 bp, Artificial Sequence
  Synthetic Polynucleotide
aggcccactcccatagg

SEQ ID NO: 9575 - DNA, 17 bp, Artificial Sequence
  Synthetic Polynucleotide
gtggtggacttctctca

SEQ ID NO: 9576 - DNA, 17 bp, Artificial Sequence
  Synthetic Polynucleotide
acgtgcagaggtgaagc

SEQ ID NO: 9577 - DNA, 17 bp, Artificial Sequence
  Synthetic Polynucleotide
gcgcacctctctttacg

SEQ ID NO: 9578 - DNA, 18 bp, Artificial Sequence
  Synthetic Polynucleotide
gaacgtcttctcccatag

SEQ ID NO: 9579 - DNA, 18 bp, Artificial Sequence
  Synthetic Polynucleotide
ccattgaagcaatcacta

SEQ ID NO: 9580 - DNA, 18 bp, Artificial Sequence
  Synthetic Polynucleotide
tatgcctacagcctccta

SEQ ID NO: 9581 - DNA, 18 bp, Artificial Sequence
  Synthetic Polynucleotide
gtttgctgacgcaacccc

SEQ ID NO: 9582 - DNA, 17 bp, Artificial Sequence
  Synthetic Polynucleotide
gtcaccccagaaaccac

SEQ ID NO: 9583 - DNA, 17 bp, Artificial Sequence
  Synthetic Polynucleotide
tgcctatgctgcccgcg

SEQ ID NO: 9584 - DNA, 17 bp, Artificial Sequence
  Synthetic Polynucleotide
agccaaagcacatcatt

SEQ ID NO: 9585 - DNA, 17 bp, Artificial Sequence
  Synthetic Polynucleotide
gaattgatttcgtcggc

SEQ ID NO: 9586 - DNA, 17 bp, Artificial Sequence
  Synthetic Polynucleotide
gctgctcatcacgccca

SEQ ID NO: 9587 - DNA, 18 bp, Artificial Sequence
  Synthetic Polynucleotide
gccagggtaagaatggac

SEQ ID NO: 9588 - DNA, 17 bp, Artificial Sequence
  Synthetic Polynucleotide
gtcaagctccaggacgg

SEQ ID NO: 9589 - DNA, 17 bp, Artificial Sequence
  Synthetic Polynucleotide
ggccaggttcatcccca

SEQ ID NO: 9590 - DNA, 17 bp, Artificial Sequence
  Synthetic Polynucleotide
tgttcgagggagaccag

SEQ ID NO: 9591 - DNA, 18 bp, Artificial Sequence
  Synthetic Polynucleotide
ttttatttgcccatccta

SEQ ID NO: 9592 - DNA, 17 bp, Artificial Sequence
  Synthetic Polynucleotide
ccatgtacttgagcagg

SEQ ID NO: 9593 - DNA, 18 bp, Artificial Sequence
  Synthetic Polynucleotide
tactacttttacaacgcc

SEQ ID NO: 9594 - DNA, 18 bp, Artificial Sequence
  Synthetic Polynucleotide
ctttgccagcctctaccc

SEQ ID NO: 9595 - DNA, 18 bp, Artificial Sequence
  Synthetic Polynucleotide
acagcgagtccgtgtccc

SEQ ID NO: 9596 - DNA, 17 bp, Artificial Sequence
  Synthetic Polynucleotide
gccctgagccagtgcca

SEQ ID NO: 9597 - DNA, 18 bp, Artificial Sequence
  Synthetic Polynucleotide
tccagaaccactgcgggt

SEQ ID NO: 9598 - DNA, 18 bp, Artificial Sequence
  Synthetic Polynucleotide
ccgatatcctgatcttgg

SEQ ID NO: 9599 - DNA, 17 bp, Artificial Sequence
  Synthetic Polynucleotide
tagagtgtttgggtgaa

SEQ ID NO: 9600 - DNA, 18 bp, Artificial Sequence
  Synthetic Polynucleotide
gcgagtgcaacattagga

SEQ ID NO: 9601 - DNA, 18 bp, Artificial Sequence
  Synthetic Polynucleotide
ttcatgtagttgattgcg

SEQ ID NO: 9602 - DNA, 18 bp, Artificial Sequence
  Synthetic Polynucleotide
ttttgcatcttgtgacga

SEQ ID NO: 9603 - DNA, 17 bp, Artificial Sequence
  Synthetic Polynucleotide
aaacgaccatcagcaag

SEQ ID NO: 9604 - DNA, 17 bp, Artificial Sequence
  Synthetic Polynucleotide
gcgagtgcctcatgatc

SEQ ID NO: 9605 - DNA, 17 bp, Artificial Sequence
  Synthetic Polynucleotide
cgcgacgagtttcctca

SEQ ID NO: 9606 - DNA, 17 bp, Artificial Sequence
  Synthetic Polynucleotide
ggccagtaccagctttt

SEQ ID NO: 9607 - DNA, 18 bp, Artificial Sequence
  Synthetic Polynucleotide
gttcctgaagccatagca

SEQ ID NO: 9608 - DNA, 18 bp, Artificial Sequence
  Synthetic Polynucleotide
tggatttcctttctgagc

SEQ ID NO: 9609 - DNA, 17 bp, Artificial Sequence
  Synthetic Polynucleotide
tgaaccaatcccagcca

SEQ ID NO: 9610 - DNA, 17 bp, Artificial Sequence
  Synthetic Polynucleotide
cggtgtcagtaacttca

SEQ ID NO: 9611 - DNA, 17 bp, Artificial Sequence
  Synthetic Polynucleotide
ctaccagtgctacaaca

SEQ ID NO: 9612 - DNA, 17 bp, Artificial Sequence
  Synthetic Polynucleotide
gtcagtctgaaccttgg

SEQ ID NO: 9613 - DNA, 18 bp, Artificial Sequence
  Synthetic Polynucleotide
ccgtggaagaagagtccc

SEQ ID NO: 9614 - DNA, 18 bp, Artificial Sequence
  Synthetic Polynucleotide
cgcccttagaagtccagc

SEQ ID NO: 9615 - DNA, 17 bp, Artificial Sequence
  Synthetic Polynucleotide
ggccttagccgagcccg

SEQ ID NO: 9616 - DNA, 17 bp, Artificial Sequence
  Synthetic Polynucleotide
cttgaaccagccgacgt

SEQ ID NO: 9617 - DNA, 17 bp, Artificial Sequence
  Synthetic Polynucleotide
gagttcctctacgccct

SEQ ID NO: 9618 - DNA, 18 bp, Artificial Sequence
  Synthetic Polynucleotide
ctgtggaattttgccagc

SEQ ID NO: 9619 - DNA, 18 bp, Artificial Sequence
  Synthetic Polynucleotide
tcaacattccagtctctt

SEQ ID NO: 9620 - DNA, 17 bp, Artificial Sequence
  Synthetic Polynucleotide
acagttttcctcatccc

SEQ ID NO: 9621 - DNA, 18 bp, Artificial Sequence
  Synthetic Polynucleotide
tacgttcttattgaagca

SEQ ID NO: 9622 - DNA, 17 bp, Artificial Sequence
  Synthetic Polynucleotide
ctccaggtagtccttgc

SEQ ID NO: 9623 - DNA, 17 bp, Artificial Sequence
  Synthetic Polynucleotide
gactttgccagcctgta

SEQ ID NO: 9624 - DNA, 17 bp, Artificial Sequence
  Synthetic Polynucleotide
tcctcatcatcctcctc

SEQ ID NO: 9625 - DNA, 18 bp, Artificial Sequence
  Synthetic Polynucleotide
acacttcgtggattagag

SEQ ID NO: 9626 - DNA, 18 bp, Artificial Sequence
  Synthetic Polynucleotide
cctatgcctgagttatgc

SEQ ID NO: 9627 - DNA, 18 bp, Artificial Sequence
  Synthetic Polynucleotide
gctgaactttagcagaaa

SEQ ID NO: 9628 - DNA, 18 bp, Artificial Sequence
  Synthetic Polynucleotide
gtttcatcgagccgtgat

SEQ ID NO: 9629 - DNA, 17 bp, Artificial Sequence
  Synthetic Polynucleotide
cgacatcatacgccagt

SEQ ID NO: 9630 - DNA, 17 bp, Artificial Sequence
  Synthetic Polynucleotide
cgaagaccgatttggag

SEQ ID NO: 9631 - DNA, 17 bp, Artificial Sequence
  Synthetic Polynucleotide
atgccaaagcatccata

SEQ ID NO: 9632 - DNA, 18 bp, Artificial Sequence
  Synthetic Polynucleotide
tcctttccgtttgaaaat

SEQ ID NO: 9633 - DNA, 18 bp, Artificial Sequence
  Synthetic Polynucleotide
ggtgacaacccctattaa

SEQ ID NO: 9634 - DNA, 18 bp, Artificial Sequence
  Synthetic Polynucleotide
tccgacgtacttgaaaat

SEQ ID NO: 9635 - DNA, 17 bp, Artificial Sequence
  Synthetic Polynucleotide
taagtcaagccgacgag

SEQ ID NO: 9636 - DNA, 17 bp, Artificial Sequence
  Synthetic Polynucleotide
acattttgacgagcctg

SEQ ID NO: 9637 - DNA, 17 bp, Artificial Sequence
  Synthetic Polynucleotide
tgtgcgacagtacttac

SEQ ID NO: 9638 - DNA, 18 bp, Artificial Sequence
  Synthetic Polynucleotide
gcatctccgtatctgtta

SEQ ID NO: 9639 - DNA, 18 bp, Artificial Sequence
  Synthetic Polynucleotide
aggagattacgtgccagg

SEQ ID NO: 9640 - DNA, 18 bp, Artificial Sequence
  Synthetic Polynucleotide
ggaccaacaaaaccataa

SEQ ID NO: 9641 - DNA, 18 bp, Artificial Sequence
  Synthetic Polynucleotide
gtaccatgtgacctcatt

SEQ ID NO: 9642 - DNA, 17 bp, Artificial Sequence
  Synthetic Polynucleotide
tgtcctctctgtgtgtc

SEQ ID NO: 9643 - DNA, 18 bp, Artificial Sequence
  Synthetic Polynucleotide
tccaacatccagttttac

SEQ ID NO: 9644 - DNA, 17 bp, Artificial Sequence
  Synthetic Polynucleotide
gcgtgtctatagccttt

SEQ ID NO: 9645 - DNA, 18 bp, Artificial Sequence
  Synthetic Polynucleotide
acgatcttaccagccgtc

SEQ ID NO: 9646 - DNA, 18 bp, Artificial Sequence
  Synthetic Polynucleotide
ctgaatcttgccatctgt

SEQ ID NO: 9647 - DNA, 18 bp, Artificial Sequence
  Synthetic Polynucleotide
ccaccttatttgatctgc

SEQ ID NO: 9648 - DNA, 17 bp, Artificial Sequence
  Synthetic Polynucleotide
tgtagacgatcctacgt

SEQ ID NO: 9649 - DNA, 17 bp, Artificial Sequence
  Synthetic Polynucleotide
ttggtggtaggcgtgta

SEQ ID NO: 9650 - DNA, 17 bp, Artificial Sequence
  Synthetic Polynucleotide
ggtctctggacatccat

SEQ ID NO: 9651 - DNA, 17 bp, Artificial Sequence
  Synthetic Polynucleotide
cccagaagtgcatgaaa

SEQ ID NO: 9652 - DNA, 17 bp, Artificial Sequence
  Synthetic Polynucleotide
aagagaggtggaccaaa

SEQ ID NO: 9653 - DNA, 17 bp, Artificial Sequence
  Synthetic Polynucleotide
atttggcgtacaaacac

SEQ ID NO: 9654 - DNA, 18 bp, Artificial Sequence
  Synthetic Polynucleotide
ggttaggaacaaaagcgc

SEQ ID NO: 9655 - DNA, 17 bp, Artificial Sequence
  Synthetic Polynucleotide
attcgggatgcttatcc

SEQ ID NO: 9656 - DNA, 18 bp, Artificial Sequence
  Synthetic Polynucleotide
ccgttccgttgatttgga

SEQ ID NO: 9657 - DNA, 18 bp, Artificial Sequence
  Synthetic Polynucleotide
ttgggtttccagttctac

SEQ ID NO: 9658 - DNA, 17 bp, Artificial Sequence
  Synthetic Polynucleotide
acactgagtttcgtcac

SEQ ID NO: 9659 - DNA, 18 bp, Artificial Sequence
  Synthetic Polynucleotide
tcggtatcaagctgttta

SEQ ID NO: 9660 - DNA, 17 bp, Artificial Sequence
  Synthetic Polynucleotide
tatccaatgcgataggc

SEQ ID NO: 9661 - DNA, 18 bp, Artificial Sequence
  Synthetic Polynucleotide
tgaggcgggtattgatca

SEQ ID NO: 9662 - DNA, 17 bp, Artificial Sequence
  Synthetic Polynucleotide
acaacaaccaccagaaa

SEQ ID NO: 9663 - DNA, 18 bp, Artificial Sequence
  Synthetic Polynucleotide
ttagcgagtggtgttggt

SEQ ID NO: 9664 - DNA, 17 bp, Artificial Sequence
  Synthetic Polynucleotide
tacaggcggtagttaaa

SEQ ID NO: 9665 - DNA, 18 bp, Artificial Sequence
  Synthetic Polynucleotide
atgctgataattgggagt

SEQ ID NO: 9666 - DNA, 17 bp, Artificial Sequence
  Synthetic Polynucleotide
ctccgtgttttccgtcg

SEQ ID NO: 9667 - DNA, 17 bp, Artificial Sequence
  Synthetic Polynucleotide
cgggtcgatcagaagat

SEQ ID NO: 9668 - DNA, 18 bp, Artificial Sequence
  Synthetic Polynucleotide
tcgagattcgtagccacc

SEQ ID NO: 9669 - DNA, 18 bp, Artificial Sequence
  Synthetic Polynucleotide
tctggcaagatttattgg

SEQ ID NO: 9670 - DNA, 17 bp, Artificial Sequence
  Synthetic Polynucleotide
ggttgcttcaccctcta

SEQ ID NO: 9671 - DNA, 17 bp, Artificial Sequence
  Synthetic Polynucleotide
tgctgggtattcagagg

SEQ ID NO: 9672 - DNA, 18 bp, Artificial Sequence
  Synthetic Polynucleotide
ggtcaaagtcgatgtgtt

SEQ ID NO: 9673 - DNA, 18 bp, Artificial Sequence
  Synthetic Polynucleotide
ccgattcaaggcagagaa

SEQ ID NO: 9674 - DNA, 17 bp, Artificial Sequence
  Synthetic Polynucleotide
cttcagttcgtcgtctg

SEQ ID NO: 9675 - DNA, 18 bp, Artificial Sequence
  Synthetic Polynucleotide
gcgggtatgaccaggtac

SEQ ID NO: 9676 - DNA, 17 bp, Artificial Sequence
  Synthetic Polynucleotide
gggcgtgggtttggcgt

SEQ ID NO: 9677 - DNA, 18 bp, Artificial Sequence
  Synthetic Polynucleotide
gagatttgcaccttccac

SEQ ID NO: 9678 - DNA, 17 bp, Artificial Sequence
  Synthetic Polynucleotide
tcgtgtagttggtaacg

SEQ ID NO: 9679 - DNA, 18 bp, Artificial Sequence
  Synthetic Polynucleotide
gaattgcaggaggaaaag

SEQ ID NO: 9680 - DNA, 17 bp, Artificial Sequence
  Synthetic Polynucleotide
ccaggatcattccatca

SEQ ID NO: 9681 - DNA, 17 bp, Artificial Sequence
  Synthetic Polynucleotide
cggtcgtgattgtcggg

SEQ ID NO: 9682 - DNA, 18 bp, Artificial Sequence
  Synthetic Polynucleotide
tcatttggcggtatttta

SEQ ID NO: 9683 - DNA, 18 bp, Artificial Sequence
  Synthetic Polynucleotide
tgtcggtagttctattga

SEQ ID NO: 9684 - DNA, 18 bp, Artificial Sequence
  Synthetic Polynucleotide
taaaggaggtattccagt

SEQ ID NO: 9685 - DNA, 18 bp, Artificial Sequence
  Synthetic Polynucleotide
gctcttatttgagcgttt

SEQ ID NO: 9686 - DNA, 18 bp, Artificial Sequence
  Synthetic Polynucleotide
aacaaacagctacaatga

SEQ ID NO: 9687 - DNA, 17 bp, Artificial Sequence
  Synthetic Polynucleotide
tgttcaggtgctctgcg

SEQ ID NO: 9688 - DNA, 18 bp, Artificial Sequence
  Synthetic Polynucleotide
gaggttcttcatggtgag

SEQ ID NO: 9689 - DNA, 17 bp, Artificial Sequence
  Synthetic Polynucleotide
aggtcaccctcatcata

SEQ ID NO: 9690 - DNA, 18 bp, Artificial Sequence
  Synthetic Polynucleotide
ccaatgaatccttcgtgg

SEQ ID NO: 9691 - DNA, 18 bp, Artificial Sequence
  Synthetic Polynucleotide
tctcgctcgaactcggaa

SEQ ID NO: 9692 - DNA, 17 bp, Artificial Sequence
  Synthetic Polynucleotide
cccaggaggcccagaga

SEQ ID NO: 9693 - DNA, 17 bp, Artificial Sequence
  Synthetic Polynucleotide
tccagctccatatcgtc

SEQ ID NO: 9694 - DNA, 17 bp, Artificial Sequence
  Synthetic Polynucleotide
tgtccaaaatgtccagg

SEQ ID NO: 9695 - DNA, 18 bp, Artificial Sequence
  Synthetic Polynucleotide
taaccctttacctaagct

SEQ ID NO: 9696 - DNA, 18 bp, Artificial Sequence
  Synthetic Polynucleotide
ggtagtgtatggggatac

SEQ ID NO: 9697 - DNA, 18 bp, Artificial Sequence
  Synthetic Polynucleotide
caatcgcatgattccata

SEQ ID NO: 9698 - DNA, 18 bp, Artificial Sequence
  Synthetic Polynucleotide
tgacttccgctaatgaaa

SEQ ID NO: 9699 - DNA, 18 bp, Artificial Sequence
  Synthetic Polynucleotide
acggctcagaaaacgtgt

SEQ ID NO: 9700 - DNA, 17 bp, Artificial Sequence
  Synthetic Polynucleotide
tcctgagacttcggaga

SEQ ID NO: 9701 - DNA, 18 bp, Artificial Sequence
  Synthetic Polynucleotide
ttaccactcattggagag

SEQ ID NO: 9702 - DNA, 17 bp, Artificial Sequence
  Synthetic Polynucleotide
gcagcccgatctatttt

SEQ ID NO: 9703 - DNA, 17 bp, Artificial Sequence
  Synthetic Polynucleotide
cacaagggttcaagttg

SEQ ID NO: 9704 - DNA, 18 bp, Artificial Sequence
  Synthetic Polynucleotide
gtgtagccattacccatg

SEQ ID NO: 9705 - DNA, 17 bp, Artificial Sequence
  Synthetic Polynucleotide
aggatgttaccaaacgc

SEQ ID NO: 9706 - DNA, 17 bp, Artificial Sequence
  Synthetic Polynucleotide
tgacgactttacagcaa

SEQ ID NO: 9707 - DNA, 18 bp, Artificial Sequence
  Synthetic Polynucleotide
cgcaacacagcctcaaac

SEQ ID NO: 9708 - DNA, 17 bp, Artificial Sequence
  Synthetic Polynucleotide
tattacggcctaccact

SEQ ID NO: 9709 - DNA, 18 bp, Artificial Sequence
  Synthetic Polynucleotide
gtagggtcaaggaaaccc

SEQ ID NO: 9710 - DNA, 17 bp, Artificial Sequence
  Synthetic Polynucleotide
tccggtatcttgacgcc

SEQ ID NO: 9711 - DNA, 17 bp, Artificial Sequence
  Synthetic Polynucleotide
gttgtccaactgactca

SEQ ID NO: 9712 - DNA, 17 bp, Artificial Sequence
  Synthetic Polynucleotide
cgaccacactttcgttc

SEQ ID NO: 9713 - DNA, 18 bp, Artificial Sequence
  Synthetic Polynucleotide
tatagacactgaaccact

SEQ ID NO: 9714 - DNA, 18 bp, Artificial Sequence
  Synthetic Polynucleotide
gtctgtttgtctgacttc

SEQ ID NO: 9715 - DNA, 18 bp, Artificial Sequence
  Synthetic Polynucleotide
caacgggcacaggtaaat

SEQ ID NO: 9716 - DNA, 18 bp, Artificial Sequence
  Synthetic Polynucleotide
cgtctgctttctcgtaag

SEQ ID NO: 9717 - DNA, 18 bp, Artificial Sequence
  Synthetic Polynucleotide
gtctacctatttggggtt

SEQ ID NO: 9718 - DNA, 17 bp, Artificial Sequence
  Synthetic Polynucleotide
gccgagtctatcagact

SEQ ID NO: 9719 - DNA, 18 bp, Artificial Sequence
  Synthetic Polynucleotide
ctccaccctcgttgcaat

SEQ ID NO: 9720 - DNA, 18 bp, Artificial Sequence
  Synthetic Polynucleotide
gggaaacgagccaagtgg

SEQ ID NO: 9721 - DNA, 18 bp, Artificial Sequence
  Synthetic Polynucleotide
gagagctaatgtacaggg

SEQ ID NO: 9722 - DNA, 18 bp, Artificial Sequence
  Synthetic Polynucleotide
tccacatctgcaatcaat

SEQ ID NO: 9723 - DNA, 18 bp, Artificial Sequence
  Synthetic Polynucleotide
actacgactcttcctagg

SEQ ID NO: 9724 - DNA, 17 bp, Artificial Sequence
  Synthetic Polynucleotide
tctggttttgaatcccc

SEQ ID NO: 9725 - DNA, 18 bp, Artificial Sequence
  Synthetic Polynucleotide
agccagtccgaaacgctc

SEQ ID NO: 9726 - DNA, 17 bp, Artificial Sequence
  Synthetic Polynucleotide
gctaccgcctcatcatg

SEQ ID NO: 9727 - DNA, 18 bp, Artificial Sequence
  Synthetic Polynucleotide
cttctgactccgaatccg

SEQ ID NO: 9728 - DNA, 18 bp, Artificial Sequence
  Synthetic Polynucleotide
aagctgacaatagttgga

SEQ ID NO: 9729 - DNA, 18 bp, Artificial Sequence
  Synthetic Polynucleotide
ttcctgcaatatcgccaa

SEQ ID NO: 9730 - DNA, 17 bp, Artificial Sequence
  Synthetic Polynucleotide
agtgatcaatggacacc

SEQ ID NO: 9731 - DNA, 17 bp, Artificial Sequence
  Synthetic Polynucleotide
taaaacgctcatgttgc

SEQ ID NO: 9732 - DNA, 18 bp, Artificial Sequence
  Synthetic Polynucleotide
tttcgagcacaatctaca

SEQ ID NO: 9733 - DNA, 18 bp, Artificial Sequence
  Synthetic Polynucleotide
tacccacgtataacactg

SEQ ID NO: 9734 - DNA, 18 bp, Artificial Sequence
  Synthetic Polynucleotide
ccgcccactctaaagata

SEQ ID NO: 9735 - DNA, 18 bp, Artificial Sequence
  Synthetic Polynucleotide
ttaacgcctcgtccttct

SEQ ID NO: 9736 - DNA, 18 bp, Artificial Sequence
  Synthetic Polynucleotide
tggcgagggtcacattga

SEQ ID NO: 9737 - DNA, 18 bp, Artificial Sequence
  Synthetic Polynucleotide
taataagcaatgacggca

SEQ ID NO: 9738 - DNA, 18 bp, Artificial Sequence
  Synthetic Polynucleotide
taaatcgaagtggactgc

SEQ ID NO: 9739 - DNA, 18 bp, Artificial Sequence
  Synthetic Polynucleotide
accgcctacataccagag

SEQ ID NO: 9740 - DNA, 17 bp, Artificial Sequence
  Synthetic Polynucleotide
tcctgctcctgttgagt

SEQ ID NO: 9741 - DNA, 17 bp, Artificial Sequence
  Synthetic Polynucleotide
atccaatcgctgtacca

SEQ ID NO: 9742 - DNA, 17 bp, Artificial Sequence
  Synthetic Polynucleotide
ggaggttcttcaactcc

SEQ ID NO: 9743 - DNA, 17 bp, Artificial Sequence
  Synthetic Polynucleotide
atctcggaaacctgctg

SEQ ID NO: 9744 - DNA, 18 bp, Artificial Sequence
  Synthetic Polynucleotide
gcgacttcacgccagaat

SEQ ID NO: 9745 - DNA, 17 bp, Artificial Sequence
  Synthetic Polynucleotide
tggtttgccatactgca

SEQ ID NO: 9746 - DNA, 17 bp, Artificial Sequence
  Synthetic Polynucleotide
ctacccgcactcgtagc

SEQ ID NO: 9747 - DNA, 18 bp, Artificial Sequence
  Synthetic Polynucleotide
cctttagcacccttagca

SEQ ID NO: 9748 - DNA, 17 bp, Artificial Sequence
  Synthetic Polynucleotide
gcttctgctgttcagga

SEQ ID NO: 9749 - DNA, 17 bp, Artificial Sequence
  Synthetic Polynucleotide
taaccctaattccagga

SEQ ID NO: 9750 - DNA, 18 bp, Artificial Sequence
  Synthetic Polynucleotide
cagacgcctgtttatcct

SEQ ID NO: 9751 - DNA, 18 bp, Artificial Sequence
  Synthetic Polynucleotide
cttcacggttgatttcca

SEQ ID NO: 9752 - DNA, 17 bp, Artificial Sequence
  Synthetic Polynucleotide
gctgaaggtatggctac

SEQ ID NO: 9753 - DNA, 18 bp, Artificial Sequence
  Synthetic Polynucleotide
cccgttcgaggagctgca

SEQ ID NO: 9754 - DNA, 18 bp, Artificial Sequence
  Synthetic Polynucleotide
ccattgcggttttcattt

SEQ ID NO: 9755 - DNA, 18 bp, Artificial Sequence
  Synthetic Polynucleotide
gacgttttgatcgtcagc

SEQ ID NO: 9756 - DNA, 17 bp, Artificial Sequence
  Synthetic Polynucleotide
ccgaggatgatctgatc

SEQ ID NO: 9757 - DNA, 18 bp, Artificial Sequence
  Synthetic Polynucleotide
aacgaattgtggttgttg

SEQ ID NO: 9758 - DNA, 18 bp, Artificial Sequence
  Synthetic Polynucleotide
tgcaagacaacagcggta

SEQ ID NO: 9759 - DNA, 18 bp, Artificial Sequence
  Synthetic Polynucleotide
aagaatgatgcacgtttc

SEQ ID NO: 9760 - DNA, 18 bp, Artificial Sequence
  Synthetic Polynucleotide
aagaacatcgactccaag

SEQ ID NO: 9761 - DNA, 17 bp, Artificial Sequence
  Synthetic Polynucleotide
aggtagcgtaacactgg

SEQ ID NO: 9762 - DNA, 17 bp, Artificial Sequence
  Synthetic Polynucleotide
aatgtaacccttggtgc

SEQ ID NO: 9763 - DNA, 17 bp, Artificial Sequence
  Synthetic Polynucleotide
actccgaagtattgggc

SEQ ID NO: 9764 - DNA, 18 bp, Artificial Sequence
  Synthetic Polynucleotide
tatcgtctgggaaaatgt

SEQ ID NO: 9765 - DNA, 17 bp, Artificial Sequence
  Synthetic Polynucleotide
atcttgtcatgggcttt

SEQ ID NO: 9766 - DNA, 17 bp, Artificial Sequence
  Synthetic Polynucleotide
tgccttttgtgtgggta

SEQ ID NO: 9767 - DNA, 18 bp, Artificial Sequence
  Synthetic Polynucleotide
ttgcgacacgtttacctt

SEQ ID NO: 9768 - DNA, 18 bp, Artificial Sequence
  Synthetic Polynucleotide
tattttatttggtgcggt

SEQ ID NO: 9769 - DNA, 17 bp, Artificial Sequence
  Synthetic Polynucleotide
tttgccttttgaggtgg

SEQ ID NO: 9770 - DNA, 18 bp, Artificial Sequence
  Synthetic Polynucleotide
agtgcgaagaattgtgga

SEQ ID NO: 9771 - DNA, 17 bp, Artificial Sequence
  Synthetic Polynucleotide
ttgatcgtttccgaagt

SEQ ID NO: 9772 - DNA, 17 bp, Artificial Sequence
  Synthetic Polynucleotide
atctcgttttggcttcg

SEQ ID NO: 9773 - DNA, 17 bp, Artificial Sequence
  Synthetic Polynucleotide
ggtagtctctaggtggc

SEQ ID NO: 9774 - DNA, 18 bp, Artificial Sequence
  Synthetic Polynucleotide
acctttcatgtgattggg

SEQ ID NO: 9775 - DNA, 17 bp, Artificial Sequence
  Synthetic Polynucleotide
gttcctgggatttgctg

SEQ ID NO: 9776 - DNA, 17 bp, Artificial Sequence
  Synthetic Polynucleotide
cgaaatggatgctggta

SEQ ID NO: 9777 - DNA, 17 bp, Artificial Sequence
  Synthetic Polynucleotide
tgagggctgggacagta

SEQ ID NO: 9778 - DNA, 17 bp, Artificial Sequence
  Synthetic Polynucleotide
ttataaagcgggtgccg

SEQ ID NO: 9779 - DNA, 18 bp, Artificial Sequence
  Synthetic Polynucleotide
ccgataaggaagtggaag

SEQ ID NO: 9780 - DNA, 17 bp, Artificial Sequence
  Synthetic Polynucleotide
tatcctatctgggaagc

SEQ ID NO: 9781 - DNA, 17 bp, Artificial Sequence
  Synthetic Polynucleotide
gccgactcgtagatcgt

SEQ ID NO: 9782 - DNA, 17 bp, Artificial Sequence
  Synthetic Polynucleotide
atggggattcagagcta

SEQ ID NO: 9783 - DNA, 17 bp, Artificial Sequence
  Synthetic Polynucleotide
tacgactatctgcaaga

SEQ ID NO: 9784 - DNA, 17 bp, Artificial Sequence
  Synthetic Polynucleotide
tacgttcaactttgccg

SEQ ID NO: 9785 - DNA, 17 bp, Artificial Sequence
  Synthetic Polynucleotide
cgttcggtttcctgaac

SEQ ID NO: 9786 - DNA, 18 bp, Artificial Sequence
  Synthetic Polynucleotide
ttgttcgacttgatgcga

SEQ ID NO: 9787 - DNA, 18 bp, Artificial Sequence
  Synthetic Polynucleotide
cacattggtagcgttggt

SEQ ID NO: 9788 - DNA, 18 bp, Artificial Sequence
  Synthetic Polynucleotide
tttggtgggtatctcgtt

SEQ ID NO: 9789 - DNA, 18 bp, Artificial Sequence
  Synthetic Polynucleotide
ctcactatgcggtctaac

SEQ ID NO: 9790 - DNA, 18 bp, Artificial Sequence
  Synthetic Polynucleotide
ggtcaggttagtgcgtat

SEQ ID NO: 9791 - DNA, 17 bp, Artificial Sequence
  Synthetic Polynucleotide
tctcctttgttctctgc

SEQ ID NO: 9792 - DNA, 18 bp, Artificial Sequence
  Synthetic Polynucleotide
ttctggctatggtaagga

SEQ ID NO: 9793 - DNA, 18 bp, Artificial Sequence
  Synthetic Polynucleotide
aatggtgctaaaagtcca

SEQ ID NO: 9794 - DNA, 18 bp, Artificial Sequence
  Synthetic Polynucleotide
cgattgattggtggcata

SEQ ID NO: 9795 - DNA, 18 bp, Artificial Sequence
  Synthetic Polynucleotide
tgtctgcgtttggtttca

SEQ ID NO: 9796 - DNA, 18 bp, Artificial Sequence
  Synthetic Polynucleotide
acgtttggctatacaagg

SEQ ID NO: 9797 - DNA, 18 bp, Artificial Sequence
  Synthetic Polynucleotide
ttgttgggtgagtttagt

SEQ ID NO: 9798 - DNA, 18 bp, Artificial Sequence
  Synthetic Polynucleotide
ggcgtagtaaattctgtc

SEQ ID NO: 9799 - DNA, 18 bp, Artificial Sequence
  Synthetic Polynucleotide
acccttttattgggtgga

SEQ ID NO: 9800 - DNA, 17 bp, Artificial Sequence
  Synthetic Polynucleotide
gtggctagtatgggata

SEQ ID NO: 9801 - DNA, 18 bp, Artificial Sequence
  Synthetic Polynucleotide
aatgactggtaatctgga

SEQ ID NO: 9802 - DNA, 17 bp, Artificial Sequence
  Synthetic Polynucleotide
attaactgggtggggat

SEQ ID NO: 9803 - DNA, 18 bp, Artificial Sequence
  Synthetic Polynucleotide
gattggtatctgattgcc

SEQ ID NO: 9804 - DNA, 17 bp, Artificial Sequence
  Synthetic Polynucleotide
cggcgtaattaaagagc

SEQ ID NO: 9805 - DNA, 18 bp, Artificial Sequence
  Synthetic Polynucleotide
tgtttggttttgaagagc

SEQ ID NO: 9806 - DNA, 18 bp, Artificial Sequence
  Synthetic Polynucleotide
agagttgccttttgaatg

SEQ ID NO: 9807 - DNA, 18 bp, Artificial Sequence
  Synthetic Polynucleotide
gtgcgtttaaagaagacg

SEQ ID NO: 9808 - DNA, 18 bp, Artificial Sequence
  Synthetic Polynucleotide
ttctttcagtttgtgcgt

SEQ ID NO: 9809 - DNA, 18 bp, Artificial Sequence
  Synthetic Polynucleotide
ggcattaaatttggcgta

SEQ ID NO: 9810 - DNA, 17 bp, Artificial Sequence
  Synthetic Polynucleotide
tggggcttggtttcatt

SEQ ID NO: 9811 - DNA, 17 bp, Artificial Sequence
  Synthetic Polynucleotide
caattgtttggcgtcaa

SEQ ID NO: 9812 - DNA, 17 bp, Artificial Sequence
  Synthetic Polynucleotide
ctttgcgactggtactg

SEQ ID NO: 9813 - DNA, 17 bp, Artificial Sequence
  Synthetic Polynucleotide
cgcgatattgtgtgaaa

SEQ ID NO: 9814 - DNA, 17 bp, Artificial Sequence
  Synthetic Polynucleotide
gttcttgactggttcga

SEQ ID NO: 9815 - DNA, 17 bp, Artificial Sequence
  Synthetic Polynucleotide
ctcagagtagaagtgcg

SEQ ID NO: 9816 - DNA, 17 bp, Artificial Sequence
  Synthetic Polynucleotide
cacatctgcctctgtag

SEQ ID NO: 9817 - DNA, 18 bp, Artificial Sequence
  Synthetic Polynucleotide
tgattgaagagctggaac

SEQ ID NO: 9818 - DNA, 17 bp, Artificial Sequence
  Synthetic Polynucleotide
tcctgtggttcctgtga

SEQ ID NO: 9819 - DNA, 18 bp, Artificial Sequence
  Synthetic Polynucleotide
tggtctgtttggatttcg

SEQ ID NO: 9820 - DNA, 17 bp, Artificial Sequence
  Synthetic Polynucleotide
aactggtctgtgtatcc

SEQ ID NO: 9821 - DNA, 17 bp, Artificial Sequence
  Synthetic Polynucleotide
acttaaagtatggggcg

SEQ ID NO: 9822 - DNA, 18 bp, Artificial Sequence
  Synthetic Polynucleotide
ttcgtttggcatattgta

SEQ ID NO: 9823 - DNA, 18 bp, Artificial Sequence
  Synthetic Polynucleotide
gactggtagactccatcc

SEQ ID NO: 9824 - DNA, 17 bp, Artificial Sequence
  Synthetic Polynucleotide
agtggttggacactctc

SEQ ID NO: 9825 - DNA, 18 bp, Artificial Sequence
  Synthetic Polynucleotide
gcacgttgggatgaattc

SEQ ID NO: 9826 - DNA, 18 bp, Artificial Sequence
  Synthetic Polynucleotide
gtcatcactccataaccc

SEQ ID NO: 9827 - DNA, 17 bp, Artificial Sequence
  Synthetic Polynucleotide
tttgagctggaagttca

SEQ ID NO: 9828 - DNA, 18 bp, Artificial Sequence
  Synthetic Polynucleotide
gaggttcctgaaggtatc

SEQ ID NO: 9829 - DNA, 18 bp, Artificial Sequence
  Synthetic Polynucleotide
ttcacgaatcacagatcc

SEQ ID NO: 9830 - DNA, 18 bp, Artificial Sequence
  Synthetic Polynucleotide
ggggcttagtattacccc

SEQ ID NO: 9831 - DNA, 17 bp, Artificial Sequence
  Synthetic Polynucleotide
tcactagcatcacagat

SEQ ID NO: 9832 - DNA, 18 bp, Artificial Sequence
  Synthetic Polynucleotide
gggatcagagacatttga

SEQ ID NO: 9833 - DNA, 18 bp, Artificial Sequence
  Synthetic Polynucleotide
agcaccagcatataactt

SEQ ID NO: 9834 - DNA, 18 bp, Artificial Sequence
  Synthetic Polynucleotide
acaattctgtcctcactt

SEQ ID NO: 9835 - DNA, 18 bp, Artificial Sequence
  Synthetic Polynucleotide
tgttcttcggagatgatg

SEQ ID NO: 9836 - DNA, 18 bp, Artificial Sequence
  Synthetic Polynucleotide
tatattcagtgcagcatc

SEQ ID NO: 9837 - DNA, 17 bp, Artificial Sequence
  Synthetic Polynucleotide
cggggcttagtattacc

SEQ ID NO: 9838 - DNA, 17 bp, Artificial Sequence
  Synthetic Polynucleotide
caacaattcatcctgcc

SEQ ID NO: 9839 - DNA, 17 bp, Artificial Sequence
  Synthetic Polynucleotide
cccagaagagatgaagc

SEQ ID NO: 9840 - DNA, 18 bp, Artificial Sequence
  Synthetic Polynucleotide
tcgacgcatattgctcac

SEQ ID NO: 9841 - DNA, 18 bp, Artificial Sequence
  Synthetic Polynucleotide
aacatacaacacgctatg

SEQ ID NO: 9842 - DNA, 18 bp, Artificial Sequence
  Synthetic Polynucleotide
gcggggcatagtattacc

SEQ ID NO: 9843 - DNA, 17 bp, Artificial Sequence
  Synthetic Polynucleotide
taaagggcaaaatagga

SEQ ID NO: 9844 - DNA, 18 bp, Artificial Sequence
  Synthetic Polynucleotide
cctcgcttaccctcctcg

SEQ ID NO: 9845 - DNA, 17 bp, Artificial Sequence
  Synthetic Polynucleotide
gtctttccttctcctcc

SEQ ID NO: 9846 - DNA, 18 bp, Artificial Sequence
  Synthetic Polynucleotide
ccttcgagtttggttcat

SEQ ID NO: 9847 - DNA, 18 bp, Artificial Sequence
  Synthetic Polynucleotide
aaatggacggtagataga

SEQ ID NO: 9848 - DNA, 17 bp, Artificial Sequence
  Synthetic Polynucleotide
gcacgcaaccactttcc

SEQ ID NO: 9849 - DNA, 17 bp, Artificial Sequence
  Synthetic Polynucleotide
tctccccaccttttagt

SEQ ID NO: 9850 - DNA, 18 bp, Artificial Sequence
  Synthetic Polynucleotide
cagcaacaactgtaatga

SEQ ID NO: 9851 - DNA, 18 bp, Artificial Sequence
  Synthetic Polynucleotide
cgtctttccttctcctcc

SEQ ID NO: 9852 - DNA, 18 bp, Artificial Sequence
  Synthetic Polynucleotide
cagaaacacctccaggga

SEQ ID NO: 9853 - DNA, 18 bp, Artificial Sequence
  Synthetic Polynucleotide
agagagtacctcatcaca

SEQ ID NO: 9854 - DNA, 18 bp, Artificial Sequence
  Synthetic Polynucleotide
ggggcttattattacccc

SEQ ID NO: 9855 - DNA, 18 bp, Artificial Sequence
  Synthetic Polynucleotide
ctttcctcctccaacaat

SEQ ID NO: 9856 - DNA, 17 bp, Artificial Sequence
  Synthetic Polynucleotide
aacgaatctgacggaag

SEQ ID NO: 9857 - DNA, 18 bp, Artificial Sequence
  Synthetic Polynucleotide
tccttctccaccttgtgg

SEQ ID NO: 9858 - DNA, 18 bp, Artificial Sequence
  Synthetic Polynucleotide
cgagagagttcaatacgc

SEQ ID NO: 9859 - DNA, 17 bp, Artificial Sequence
  Synthetic Polynucleotide
cttgggttttacctcca

SEQ ID NO: 9860 - DNA, 17 bp, Artificial Sequence
  Synthetic Polynucleotide
ggctttccctatacgct

SEQ ID NO: 9861 - DNA, 18 bp, Artificial Sequence
  Synthetic Polynucleotide
catactcagacgctactc

SEQ ID NO: 9862 - DNA, 18 bp, Artificial Sequence
  Synthetic Polynucleotide
tacagggctttattcaga

SEQ ID NO: 9863 - DNA, 18 bp, Artificial Sequence
  Synthetic Polynucleotide
cccaggaatataacacgc

SEQ ID NO: 9864 - DNA, 18 bp, Artificial Sequence
  Synthetic Polynucleotide
agaagagacatcaagctc

SEQ ID NO: 9865 - DNA, 18 bp, Artificial Sequence
  Synthetic Polynucleotide
ttcgtagtttcctcgccg

SEQ ID NO: 9866 - DNA, 17 bp, Artificial Sequence
  Synthetic Polynucleotide
agggtaatgggtggcgt

SEQ ID NO: 9867 - DNA, 17 bp, Artificial Sequence
  Synthetic Polynucleotide
tccacaggaaagccatt

SEQ ID NO: 9868 - DNA, 18 bp, Artificial Sequence
  Synthetic Polynucleotide
ccacaaaggtaacgagta

SEQ ID NO: 9869 - DNA, 17 bp, Artificial Sequence
  Synthetic Polynucleotide
atttcttcgagtgtccc

SEQ ID NO: 9870 - DNA, 17 bp, Artificial Sequence
  Synthetic Polynucleotide
agcggaacgagtttccc

SEQ ID NO: 9871 - DNA, 17 bp, Artificial Sequence
  Synthetic Polynucleotide
tgacgaggaagtgtcgg

SEQ ID NO: 9872 - DNA, 18 bp, Artificial Sequence
  Synthetic Polynucleotide
ctaagcgtagtttcccca

SEQ ID NO: 9873 - DNA, 17 bp, Artificial Sequence
  Synthetic Polynucleotide
atactgaaggttggtgc

SEQ ID NO: 9874 - DNA, 17 bp, Artificial Sequence
  Synthetic Polynucleotide
tataggttgaaggcagt

SEQ ID NO: 9875 - DNA, 17 bp, Artificial Sequence
  Synthetic Polynucleotide
ttctgataggtgaccgt

SEQ ID NO: 9876 - DNA, 17 bp, Artificial Sequence
  Synthetic Polynucleotide
ccattaggcgagctttt

SEQ ID NO: 9877 - DNA, 17 bp, Artificial Sequence
  Synthetic Polynucleotide
tcatcagttcggatcaa

SEQ ID NO: 9878 - DNA, 18 bp, Artificial Sequence
  Synthetic Polynucleotide
tttcaagggatagcctcc

SEQ ID NO: 9879 - DNA, 18 bp, Artificial Sequence
  Synthetic Polynucleotide
attggtgatggtttcaag

SEQ ID NO: 9880 - DNA, 18 bp, Artificial Sequence
  Synthetic Polynucleotide
aatctttcaggtcaggca

SEQ ID NO: 9881 - DNA, 18 bp, Artificial Sequence
  Synthetic Polynucleotide
aatgggagcgtatactag

SEQ ID NO: 9882 - DNA, 18 bp, Artificial Sequence
  Synthetic Polynucleotide
ccgtcaattatggcgaaa

SEQ ID NO: 9883 - DNA, 17 bp, Artificial Sequence
  Synthetic Polynucleotide
caagcactggctattga

SEQ ID NO: 9884 - DNA, 17 bp, Artificial Sequence
  Synthetic Polynucleotide
gactgcacggaagccgg

SEQ ID NO: 9885 - DNA, 17 bp, Artificial Sequence
  Synthetic Polynucleotide
aagttccactgagctgg

SEQ ID NO: 9886 - DNA, 18 bp, Artificial Sequence
  Synthetic Polynucleotide
cgactgcaccacgagttg

SEQ ID NO: 9887 - DNA, 17 bp, Artificial Sequence
  Synthetic Polynucleotide
caatgtgccccgcaaac

SEQ ID NO: 9888 - DNA, 18 bp, Artificial Sequence
  Synthetic Polynucleotide
catcaacaccgacgatga

SEQ ID NO: 9889 - DNA, 18 bp, Artificial Sequence
  Synthetic Polynucleotide
aaaccatttccacttcgc

SEQ ID NO: 9890 - DNA, 17 bp, Artificial Sequence
  Synthetic Polynucleotide
acccacgttcatggaag

SEQ ID NO: 9891 - DNA, 17 bp, Artificial Sequence
  Synthetic Polynucleotide
acaacaacccaaacagc

SEQ ID NO: 9892 - DNA, 18 bp, Artificial Sequence
  Synthetic Polynucleotide
tccgactacctcgccacc

SEQ ID NO: 9893 - DNA, 18 bp, Artificial Sequence
  Synthetic Polynucleotide
tacacctcacaaccaata

SEQ ID NO: 9894 - DNA, 18 bp, Artificial Sequence
  Synthetic Polynucleotide
aatcaaacccacaaggaa

SEQ ID NO: 9895 - DNA, 18 bp, Artificial Sequence
  Synthetic Polynucleotide
tagcatgttcaccaatct

SEQ ID NO: 9896 - DNA, 18 bp, Artificial Sequence
  Synthetic Polynucleotide
acacgagcaagaaaagtc

SEQ ID NO: 9897 - DNA, 18 bp, Artificial Sequence
  Synthetic Polynucleotide
actaaaccagacctctca

SEQ ID NO: 9898 - DNA, 18 bp, Artificial Sequence
  Synthetic Polynucleotide
tttctcctagacgctgat

SEQ ID NO: 9899 - DNA, 18 bp, Artificial Sequence
  Synthetic Polynucleotide
cctgagcccgcttactgg

SEQ ID NO: 9900 - DNA, 17 bp, Artificial Sequence
  Synthetic Polynucleotide
agagaaattccactgcc

SEQ ID NO: 9901 - DNA, 17 bp, Artificial Sequence
  Synthetic Polynucleotide
gacgttaatgccatcac

SEQ ID NO: 9902 - DNA, 17 bp, Artificial Sequence
  Synthetic Polynucleotide
ggtaacattttgccctg

SEQ ID NO: 9903 - DNA, 17 bp, Artificial Sequence
  Synthetic Polynucleotide
gttctaccaacaccagg

SEQ ID NO: 9904 - DNA, 18 bp, Artificial Sequence
  Synthetic Polynucleotide
cttgaactgaacccgaaa

SEQ ID NO: 9905 - DNA, 18 bp, Artificial Sequence
  Synthetic Polynucleotide
ttgctgcccctgatttta

SEQ ID NO: 9906 - DNA, 17 bp, Artificial Sequence
  Synthetic Polynucleotide
cgctcactgggcacggt

SEQ ID NO: 9907 - DNA, 17 bp, Artificial Sequence
  Synthetic Polynucleotide
tggctaaagacaagacc

SEQ ID NO: 9908 - DNA, 18 bp, Artificial Sequence
  Synthetic Polynucleotide
catccacataggctctaa

SEQ ID NO: 9909 - DNA, 17 bp, Artificial Sequence
  Synthetic Polynucleotide
tgggattcctttcgtca

SEQ ID NO: 9910 - DNA, 17 bp, Artificial Sequence
  Synthetic Polynucleotide
cgccattttccgtttct

SEQ ID NO: 9911 - DNA, 18 bp, Artificial Sequence
  Synthetic Polynucleotide
aacacagttcgagtctct

SEQ ID NO: 9912 - DNA, 18 bp, Artificial Sequence
  Synthetic Polynucleotide
attgttctttgtgtgacc

SEQ ID NO: 9913 - DNA, 17 bp, Artificial Sequence
  Synthetic Polynucleotide
tggatgtcaatccgact

SEQ ID NO: 9914 - DNA, 18 bp, Artificial Sequence
  Synthetic Polynucleotide
gcttctcagttcaagagt

SEQ ID NO: 9915 - DNA, 17 bp, Artificial Sequence
  Synthetic Polynucleotide
agcttcatcagagggac

SEQ ID NO: 9916 - DNA, 18 bp, Artificial Sequence
  Synthetic Polynucleotide
catgtatgcaaccatcaa

SEQ ID NO: 9917 - DNA, 18 bp, Artificial Sequence
  Synthetic Polynucleotide
aaaacatggaacctttgg

SEQ ID NO: 9918 - DNA, 18 bp, Artificial Sequence
  Synthetic Polynucleotide
cccaaccattttctatga

SEQ ID NO: 9919 - DNA, 17 bp, Artificial Sequence
  Synthetic Polynucleotide
tgcatcactccaaatgg

SEQ ID NO: 9920 - DNA, 18 bp, Artificial Sequence
  Synthetic Polynucleotide
ccattgatacaaacgcat

SEQ ID NO: 9921 - DNA, 17 bp, Artificial Sequence
  Synthetic Polynucleotide
tggtccagctcaagttg

SEQ ID NO: 9922 - DNA, 17 bp, Artificial Sequence
  Synthetic Polynucleotide
cctctccagaaattccg

SEQ ID NO: 9923 - DNA, 17 bp, Artificial Sequence
  Synthetic Polynucleotide
caaggcaccaaacgatc

SEQ ID NO: 9924 - DNA, 17 bp, Artificial Sequence
  Synthetic Polynucleotide
tcttctgaatactgcgg

SEQ ID NO: 9925 - DNA, 18 bp, Artificial Sequence
  Synthetic Polynucleotide
cagcttagggataatgca

SEQ ID NO: 9926 - DNA, 17 bp, Artificial Sequence
  Synthetic Polynucleotide
tccaagcgaatctctgt

SEQ ID NO: 9927 - DNA, 18 bp, Artificial Sequence
  Synthetic Polynucleotide
tctcttccaggacatact

SEQ ID NO: 9928 - DNA, 17 bp, Artificial Sequence
  Synthetic Polynucleotide
gcatcaggataacagga

SEQ ID NO: 9929 - DNA, 18 bp, Artificial Sequence
  Synthetic Polynucleotide
gggcaattcatctctttg

SEQ ID NO: 9930 - DNA, 18 bp, Artificial Sequence
  Synthetic Polynucleotide
gaattcaaaacacccgtt

SEQ ID NO: 9931 - DNA, 18 bp, Artificial Sequence
  Synthetic Polynucleotide
gaacactcaattcacagc

SEQ ID NO: 9932 - DNA, 17 bp, Artificial Sequence
  Synthetic Polynucleotide
cccatcatcattccagg

SEQ ID NO: 9933 - DNA, 18 bp, Artificial Sequence
  Synthetic Polynucleotide
agaactcaaatacctgca

SEQ ID NO: 9934 - DNA, 18 bp, Artificial Sequence
  Synthetic Polynucleotide
ccatccgaattcttttgg

SEQ ID NO: 9935 - DNA, 17 bp, Artificial Sequence
  Synthetic Polynucleotide
gtgctaattgggcaagg

SEQ ID NO: 9936 - DNA, 17 bp, Artificial Sequence
  Synthetic Polynucleotide
gaaatgctgctcccact

SEQ ID NO: 9937 - DNA, 17 bp, Artificial Sequence
  Synthetic Polynucleotide
gattggtcagggtacag

SEQ ID NO: 9938 - DNA, 17 bp, Artificial Sequence
  Synthetic Polynucleotide
ttccattcaagtccacc

SEQ ID NO: 9939 - DNA, 17 bp, Artificial Sequence
  Synthetic Polynucleotide
tccaacacgataacctc

SEQ ID NO: 9940 - DNA, 18 bp, Artificial Sequence
  Synthetic Polynucleotide
gaacaccattgctacaat

SEQ ID NO: 9941 - DNA, 17 bp, Artificial Sequence
  Synthetic Polynucleotide
acaggcaacctccaaac

SEQ ID NO: 9942 - DNA, 18 bp, Artificial Sequence
  Synthetic Polynucleotide
ggctcacttttgttgtga

SEQ ID NO: 9943 - DNA, 18 bp, Artificial Sequence
  Synthetic Polynucleotide
tgccaccataaactttga

SEQ ID NO: 9944 - DNA, 17 bp, Artificial Sequence
  Synthetic Polynucleotide
gccatcaactccgatat

SEQ ID NO: 9945 - DNA, 17 bp, Artificial Sequence
  Synthetic Polynucleotide
acactttgctctaaccc

SEQ ID NO: 9946 - DNA, 17 bp, Artificial Sequence
  Synthetic Polynucleotide
tcctttcgtcagtccga

SEQ ID NO: 9947 - DNA, 17 bp, Artificial Sequence
  Synthetic Polynucleotide
cctgcaatcattccttc

SEQ ID NO: 9948 - DNA, 17 bp, Artificial Sequence
  Synthetic Polynucleotide
aagttcacctcatctgc

SEQ ID NO: 9949 - DNA, 17 bp, Artificial Sequence
  Synthetic Polynucleotide
gccattgctcttcctat

SEQ ID NO: 9950 - DNA, 18 bp, Artificial Sequence
  Synthetic Polynucleotide
ggcaccttttacaagatg

SEQ ID NO: 9951 - DNA, 17 bp, Artificial Sequence
  Synthetic Polynucleotide
gcacttccatcagtcat

SEQ ID NO: 9952 - DNA, 17 bp, Artificial Sequence
  Synthetic Polynucleotide
ttgggaaccaaacaagt

SEQ ID NO: 9953 - DNA, 17 bp, Artificial Sequence
  Synthetic Polynucleotide
tcctttgcaattccttc

SEQ ID NO: 9954 - DNA, 17 bp, Artificial Sequence
  Synthetic Polynucleotide
cagcgagatcttcagtg

SEQ ID NO: 9955 - DNA, 18 bp, Artificial Sequence
  Synthetic Polynucleotide
tcaaatgcttcaaatgca

SEQ ID NO: 9956 - DNA, 18 bp, Artificial Sequence
  Synthetic Polynucleotide
tttctcaagacactagga

SEQ ID NO: 9957 - DNA, 18 bp, Artificial Sequence
  Synthetic Polynucleotide
tccattccccatttcatt

SEQ ID NO: 9958 - DNA, 18 bp, Artificial Sequence
  Synthetic Polynucleotide
aaggacaatctcatctga

SEQ ID NO: 9959 - DNA, 18 bp, Artificial Sequence
  Synthetic Polynucleotide
cccaacacggtagatagc

SEQ ID NO: 9960 - DNA, 18 bp, Artificial Sequence
  Synthetic Polynucleotide
tgaaggctcaaatacctt

SEQ ID NO: 9961 - DNA, 18 bp, Artificial Sequence
  Synthetic Polynucleotide
atgctagagtcccgtttc

SEQ ID NO: 9962 - DNA, 18 bp, Artificial Sequence
  Synthetic Polynucleotide
taaaacttctcccctttg

SEQ ID NO: 9963 - DNA, 17 bp, Artificial Sequence
  Synthetic Polynucleotide
ggtagtggtccatcaat

SEQ ID NO: 9964 - DNA, 17 bp, Artificial Sequence
  Synthetic Polynucleotide
agatcctccatacagcc

SEQ ID NO: 9965 - DNA, 17 bp, Artificial Sequence
  Synthetic Polynucleotide
cctttcactgctgctcc

SEQ ID NO: 9966 - DNA, 18 bp, Artificial Sequence
  Synthetic Polynucleotide
gtctcaaggcaccaaacg

SEQ ID NO: 9967 - DNA, 18 bp, Artificial Sequence
  Synthetic Polynucleotide
tgtaagacacattccaga

SEQ ID NO: 9968 - DNA, 18 bp, Artificial Sequence
  Synthetic Polynucleotide
caaactccacagaaactg

SEQ ID NO: 9969 - DNA, 17 bp, Artificial Sequence
  Synthetic Polynucleotide
accattcttccaacaga

SEQ ID NO: 9970 - DNA, 18 bp, Artificial Sequence
  Synthetic Polynucleotide
cattactgcttctccaag

SEQ ID NO: 9971 - DNA, 18 bp, Artificial Sequence
  Synthetic Polynucleotide
ccttcttttccaggacat

SEQ ID NO: 9972 - DNA, 17 bp, Artificial Sequence
  Synthetic Polynucleotide
tgcttttcaacctcagt

SEQ ID NO: 9973 - DNA, 17 bp, Artificial Sequence
  Synthetic Polynucleotide
tcaggcatcaaaatgca

SEQ ID NO: 9974 - DNA, 18 bp, Artificial Sequence
  Synthetic Polynucleotide
cccttatcatctcaaccc

SEQ ID NO: 9975 - DNA, 17 bp, Artificial Sequence
  Synthetic Polynucleotide
gaatgctcatgctaccc

SEQ ID NO: 9976 - DNA, 18 bp, Artificial Sequence
  Synthetic Polynucleotide
ccttatgctctccataca

SEQ ID NO: 9977 - DNA, 17 bp, Artificial Sequence
  Synthetic Polynucleotide
ctgccattccaaaacat

SEQ ID NO: 9978 - DNA, 17 bp, Artificial Sequence
  Synthetic Polynucleotide
atgctagagtcccgttt

SEQ ID NO: 9979 - DNA, 18 bp, Artificial Sequence
  Synthetic Polynucleotide
tacaataaggcaaccaaa

SEQ ID NO: 9980 - DNA, 17 bp, Artificial Sequence
  Synthetic Polynucleotide
ccaaccatcaaccattc

SEQ ID NO: 9981 - DNA, 18 bp, Artificial Sequence
  Synthetic Polynucleotide
tcattcttcaggaacatg

SEQ ID NO: 9982 - DNA, 18 bp, Artificial Sequence
  Synthetic Polynucleotide
tccagaaatccatcttcc

SEQ ID NO: 9983 - DNA, 17 bp, Artificial Sequence
  Synthetic Polynucleotide
aattctcaaggctcagg

SEQ ID NO: 9984 - DNA, 17 bp, Artificial Sequence
  Synthetic Polynucleotide
cgccaaactctccttat

SEQ ID NO: 9985 - DNA, 17 bp, Artificial Sequence
  Synthetic Polynucleotide
ggcaccaaacgatcata

SEQ ID NO: 9986 - DNA, 17 bp, Artificial Sequence
  Synthetic Polynucleotide
ccctgctcattgctatg

SEQ ID NO: 9987 - DNA, 17 bp, Artificial Sequence
  Synthetic Polynucleotide
ggtaactgcaacaccaa

SEQ ID NO: 9988 - DNA, 17 bp, Artificial Sequence
  Synthetic Polynucleotide
gcaatctgctcacaagt

SEQ ID NO: 9989 - DNA, 18 bp, Artificial Sequence
  Synthetic Polynucleotide
cgttctctctatcatccc

SEQ ID NO: 9990 - DNA, 17 bp, Artificial Sequence
  Synthetic Polynucleotide
caaggcaaccaagaggc

SEQ ID NO: 9991 - DNA, 18 bp, Artificial Sequence
  Synthetic Polynucleotide
ttggtccatcagtcatta

SEQ ID NO: 9992 - DNA, 18 bp, Artificial Sequence
  Synthetic Polynucleotide
caggcaattcctctctct

SEQ ID NO: 9993 - DNA, 18 bp, Artificial Sequence
  Synthetic Polynucleotide
ctcatcactgcttctcca

SEQ ID NO: 9994 - DNA, 18 bp, Artificial Sequence
  Synthetic Polynucleotide
ggtagactgctttctttg

SEQ ID NO: 9995 - DNA, 17 bp, Artificial Sequence
  Synthetic Polynucleotide
ggtccagcttctctaag

SEQ ID NO: 9996 - DNA, 18 bp, Artificial Sequence
  Synthetic Polynucleotide
tctcactatactccgaag

SEQ ID NO: 9997 - DNA, 18 bp, Artificial Sequence
  Synthetic Polynucleotide
gaccagaaattccgattg

SEQ ID NO: 9998 - DNA, 18 bp, Artificial Sequence
  Synthetic Polynucleotide
ccggcaattcatctcttt

SEQ ID NO: 9999 - DNA, 18 bp, Artificial Sequence
  Synthetic Polynucleotide
tacagaatcagctctctc

SEQ ID NO: 10000 - DNA, 17 bp, Artificial Sequence
  Synthetic Polynucleotide
tgctccaaacaatcctc

SEQ ID NO: 10001 - DNA, 18 bp, Artificial Sequence
  Synthetic Polynucleotide
tctgatccgtactcattg

SEQ ID NO: 10002 - DNA, 17 bp, Artificial Sequence
  Synthetic Polynucleotide
ccaaatgtcagacccca

SEQ ID NO: 10003 - DNA, 18 bp, Artificial Sequence
  Synthetic Polynucleotide
accatatcaccatcctga

SEQ ID NO: 10004 - DNA, 18 bp, Artificial Sequence
  Synthetic Polynucleotide
taggggaacactggggca

SEQ ID NO: 10005 - DNA, 18 bp, Artificial Sequence
  Synthetic Polynucleotide
cctggcacgcatctaaac

SEQ ID NO: 10006 - DNA, 18 bp, Artificial Sequence
  Synthetic Polynucleotide
gcaaactggaaatgcttt

SEQ ID NO: 10007 - DNA, 17 bp, Artificial Sequence
  Synthetic Polynucleotide
cattgaaacgctcgctg

SEQ ID NO: 10008 - DNA, 17 bp, Artificial Sequence
  Synthetic Polynucleotide
actgaccaaagctggaa

SEQ ID NO: 10009 - DNA, 17 bp, Artificial Sequence
  Synthetic Polynucleotide
aatcccgattctacctg

SEQ ID NO: 10010 - DNA, 18 bp, Artificial Sequence
  Synthetic Polynucleotide
aaaatggctgaaggtaca

SEQ ID NO: 10011 - DNA, 17 bp, Artificial Sequence
  Synthetic Polynucleotide
tcctctccctcgtcttc

SEQ ID NO: 10012 - DNA, 18 bp, Artificial Sequence
  Synthetic Polynucleotide
tacattgtcatgtatccc

SEQ ID NO: 10013 - DNA, 17 bp, Artificial Sequence
  Synthetic Polynucleotide
ggtaacactacgcctat

SEQ ID NO: 10014 - DNA, 18 bp, Artificial Sequence
  Synthetic Polynucleotide
ccaacctccacacctgtg

SEQ ID NO: 10015 - DNA, 17 bp, Artificial Sequence
  Synthetic Polynucleotide
gcaaacgccgtaaacgt

SEQ ID NO: 10016 - DNA, 17 bp, Artificial Sequence
  Synthetic Polynucleotide
tcctcttgcagtaagtc

SEQ ID NO: 10017 - DNA, 17 bp, Artificial Sequence
  Synthetic Polynucleotide
atgttttgcatgagcct

SEQ ID NO: 10018 - DNA, 18 bp, Artificial Sequence
  Synthetic Polynucleotide
tttctgctgtctttgtcg

SEQ ID NO: 10019 - DNA, 17 bp, Artificial Sequence
  Synthetic Polynucleotide
gtcttccactagctccc

SEQ ID NO: 10020 - DNA, 18 bp, Artificial Sequence
  Synthetic Polynucleotide
cgactcccgacgctggca

SEQ ID NO: 10021 - DNA, 17 bp, Artificial Sequence
  Synthetic Polynucleotide
tattccgattaaccgtg

SEQ ID NO: 10022 - DNA, 17 bp, Artificial Sequence
  Synthetic Polynucleotide
ctcctcttcgctttccg

SEQ ID NO: 10023 - DNA, 18 bp, Artificial Sequence
  Synthetic Polynucleotide
tggacgcactgaactttc

SEQ ID NO: 10024 - DNA, 17 bp, Artificial Sequence
  Synthetic Polynucleotide
caaatggctgatcctcc

SEQ ID NO: 10025 - DNA, 18 bp, Artificial Sequence
  Synthetic Polynucleotide
gggcttgtatttgttaga

SEQ ID NO: 10026 - DNA, 17 bp, Artificial Sequence
  Synthetic Polynucleotide
ccagaaacctggatcga

SEQ ID NO: 10027 - DNA, 18 bp, Artificial Sequence
  Synthetic Polynucleotide
cgggttcttcacaacact

SEQ ID NO: 10028 - DNA, 18 bp, Artificial Sequence
  Synthetic Polynucleotide
tacaccaagttgtcacta

SEQ ID NO: 10029 - DNA, 18 bp, Artificial Sequence
  Synthetic Polynucleotide
tctcctgttgatgtaact

SEQ ID NO: 10030 - DNA, 17 bp, Artificial Sequence
  Synthetic Polynucleotide
caatcaattgcactggc

SEQ ID NO: 10031 - DNA, 17 bp, Artificial Sequence
  Synthetic Polynucleotide
tggaaatgcttcttcca

SEQ ID NO: 10032 - DNA, 17 bp, Artificial Sequence
  Synthetic Polynucleotide
gccatatccactgtccg

SEQ ID NO: 10033 - DNA, 18 bp, Artificial Sequence
  Synthetic Polynucleotide
ggacctaaaacgaaagta

SEQ ID NO: 10034 - DNA, 18 bp, Artificial Sequence
  Synthetic Polynucleotide
agtattttctcctggcac

SEQ ID NO: 10035 - DNA, 18 bp, Artificial Sequence
  Synthetic Polynucleotide
gggaatcctgtatatgca

SEQ ID NO: 10036 - DNA, 18 bp, Artificial Sequence
  Synthetic Polynucleotide
gccacatatcatctgagt

SEQ ID NO: 10037 - DNA, 17 bp, Artificial Sequence
  Synthetic Polynucleotide
gggtttgttttgcatca

SEQ ID NO: 10038 - DNA, 18 bp, Artificial Sequence
  Synthetic Polynucleotide
cttcctacccaaccgatc

SEQ ID NO: 10039 - DNA, 18 bp, Artificial Sequence
  Synthetic Polynucleotide
tttctcctggcacgcatc

SEQ ID NO: 10040 - DNA, 17 bp, Artificial Sequence
  Synthetic Polynucleotide
ggtcctgggcacgcata

SEQ ID NO: 10041 - DNA, 17 bp, Artificial Sequence
  Synthetic Polynucleotide
tcccatcatactccact

SEQ ID NO: 10042 - DNA, 17 bp, Artificial Sequence
  Synthetic Polynucleotide
ccgctgttcaaatgaaa

SEQ ID NO: 10043 - DNA, 17 bp, Artificial Sequence
  Synthetic Polynucleotide
caatggcttccttagct

SEQ ID NO: 10044 - DNA, 18 bp, Artificial Sequence
  Synthetic Polynucleotide
ccatgtcaccatcctcaa

SEQ ID NO: 10045 - DNA, 18 bp, Artificial Sequence
  Synthetic Polynucleotide
gagtagagcacttacctg

SEQ ID NO: 10046 - DNA, 17 bp, Artificial Sequence
  Synthetic Polynucleotide
ctcctcctcctctggat

SEQ ID NO: 10047 - DNA, 18 bp, Artificial Sequence
  Synthetic Polynucleotide
aacagtcacctccacgca

SEQ ID NO: 10048 - DNA, 17 bp, Artificial Sequence
  Synthetic Polynucleotide
tcatcctcatcctctga

SEQ ID NO: 10049 - DNA, 18 bp, Artificial Sequence
  Synthetic Polynucleotide
tgtcctagatttgcaacc

SEQ ID NO: 10050 - DNA, 18 bp, Artificial Sequence
  Synthetic Polynucleotide
caacatccgttgacacca

SEQ ID NO: 10051 - DNA, 17 bp, Artificial Sequence
  Synthetic Polynucleotide
ctggcacgcatctaaac

SEQ ID NO: 10052 - DNA, 18 bp, Artificial Sequence
  Synthetic Polynucleotide
ctaaaatgtccaccgtta

SEQ ID NO: 10053 - DNA, 18 bp, Artificial Sequence
  Synthetic Polynucleotide
ccatatcaccatcctgaa

SEQ ID NO: 10054 - DNA, 17 bp, Artificial Sequence
  Synthetic Polynucleotide
cagagttttaagcaccg

SEQ ID NO: 10055 - DNA, 17 bp, Artificial Sequence
  Synthetic Polynucleotide
gcgcactgatgaatacg

SEQ ID NO: 10056 - DNA, 18 bp, Artificial Sequence
  Synthetic Polynucleotide
cacactatcaccacttgc

SEQ ID NO: 10057 - DNA, 17 bp, Artificial Sequence
  Synthetic Polynucleotide
ttgaaaatcccgccttt

SEQ ID NO: 10058 - DNA, 17 bp, Artificial Sequence
  Synthetic Polynucleotide
tgcacaccacttctagt

SEQ ID NO: 10059 - DNA, 18 bp, Artificial Sequence
  Synthetic Polynucleotide
tttaaagctacacctgga

SEQ ID NO: 10060 - DNA, 17 bp, Artificial Sequence
  Synthetic Polynucleotide
ttgtttcctccaatggg

SEQ ID NO: 10061 - DNA, 17 bp, Artificial Sequence
  Synthetic Polynucleotide
tcgagaacttccaaact

SEQ ID NO: 10062 - DNA, 18 bp, Artificial Sequence
  Synthetic Polynucleotide
gctcctcctcctcctcct

SEQ ID NO: 10063 - DNA, 18 bp, Artificial Sequence
  Synthetic Polynucleotide
gcgcttccttactaacct

SEQ ID NO: 10064 - DNA, 18 bp, Artificial Sequence
  Synthetic Polynucleotide
gagcacacgtatgtctga

SEQ ID NO: 10065 - DNA, 17 bp, Artificial Sequence
  Synthetic Polynucleotide
tttgaaaatcccgcctt

SEQ ID NO: 10066 - DNA, 17 bp, Artificial Sequence
  Synthetic Polynucleotide
tctactagctccgcctc

SEQ ID NO: 10067 - DNA, 17 bp, Artificial Sequence
  Synthetic Polynucleotide
atttgaaaatcccgcct

SEQ ID NO: 10068 - DNA, 18 bp, Artificial Sequence
  Synthetic Polynucleotide
cctcgtcttcttgatcac

SEQ ID NO: 10069 - DNA, 18 bp, Artificial Sequence
  Synthetic Polynucleotide
caccaagtccacctggga

SEQ ID NO: 10070 - DNA, 18 bp, Artificial Sequence
  Synthetic Polynucleotide
taacacttcatgatctcc

SEQ ID NO: 10071 - DNA, 18 bp, Artificial Sequence
  Synthetic Polynucleotide
acacgactccaacaataa

SEQ ID NO: 10072 - DNA, 18 bp, Artificial Sequence
  Synthetic Polynucleotide
tttctcttccttccacgt

SEQ ID NO: 10073 - DNA, 18 bp, Artificial Sequence
  Synthetic Polynucleotide
cacttgtatctagcacca

SEQ ID NO: 10074 - DNA, 18 bp, Artificial Sequence
  Synthetic Polynucleotide
ccctcctaagtagattgc

SEQ ID NO: 10075 - DNA, 17 bp, Artificial Sequence
  Synthetic Polynucleotide
cactacctcctggaatg

SEQ ID NO: 10076 - DNA, 17 bp, Artificial Sequence
  Synthetic Polynucleotide
ccactacgcattctcat

SEQ ID NO: 10077 - DNA, 17 bp, Artificial Sequence
  Synthetic Polynucleotide
taatccaccacacatcc

SEQ ID NO: 10078 - DNA, 17 bp, Artificial Sequence
  Synthetic Polynucleotide
tcaatcccacgaatacc

SEQ ID NO: 10079 - DNA, 17 bp, Artificial Sequence
  Synthetic Polynucleotide
ggcactcacattgtcta

SEQ ID NO: 10080 - DNA, 18 bp, Artificial Sequence
  Synthetic Polynucleotide
tacgccacatataactgg

SEQ ID NO: 10081 - DNA, 18 bp, Artificial Sequence
  Synthetic Polynucleotide
cacctcctgagtctccgc

SEQ ID NO: 10082 - DNA, 18 bp, Artificial Sequence
  Synthetic Polynucleotide
gtcaccatcctccaaggg

SEQ ID NO: 10083 - DNA, 18 bp, Artificial Sequence
  Synthetic Polynucleotide
tgcacaccgatgaattta

SEQ ID NO: 10084 - DNA, 17 bp, Artificial Sequence
  Synthetic Polynucleotide
cttccatcctcctcctc

SEQ ID NO: 10085 - DNA, 17 bp, Artificial Sequence
  Synthetic Polynucleotide
tccgcttaccgaatgta

SEQ ID NO: 10086 - DNA, 18 bp, Artificial Sequence
  Synthetic Polynucleotide
gtcacttgtaacactgtc

SEQ ID NO: 10087 - DNA, 18 bp, Artificial Sequence
  Synthetic Polynucleotide
gctcctatgtctttgaga

SEQ ID NO: 10088 - DNA, 18 bp, Artificial Sequence
  Synthetic Polynucleotide
atagaccaccgaagtata

SEQ ID NO: 10089 - DNA, 18 bp, Artificial Sequence
  Synthetic Polynucleotide
aaatcgctgtaattgtcg

SEQ ID NO: 10090 - DNA, 18 bp, Artificial Sequence
  Synthetic Polynucleotide
ccatatccgctgtcttgt

SEQ ID NO: 10091 - DNA, 17 bp, Artificial Sequence
  Synthetic Polynucleotide
gagcacacacgctgacc

SEQ ID NO: 10092 - DNA, 18 bp, Artificial Sequence
  Synthetic Polynucleotide
tatgtccaccatgtccga

SEQ ID NO: 10093 - DNA, 18 bp, Artificial Sequence
  Synthetic Polynucleotide
cggtcatccttattatgc

SEQ ID NO: 10094 - DNA, 17 bp, Artificial Sequence
  Synthetic Polynucleotide
tgaaaagtaaccgcctg

SEQ ID NO: 10095 - DNA, 18 bp, Artificial Sequence
  Synthetic Polynucleotide
cactagacaccacctctc

SEQ ID NO: 10096 - DNA, 17 bp, Artificial Sequence
  Synthetic Polynucleotide
ctcaaaagtccgcaatc

SEQ ID NO: 10097 - DNA, 17 bp, Artificial Sequence
  Synthetic Polynucleotide
gggtccgacacaaccga

SEQ ID NO: 10098 - DNA, 17 bp, Artificial Sequence
  Synthetic Polynucleotide
gcctacacctaatggct

SEQ ID NO: 10099 - DNA, 18 bp, Artificial Sequence
  Synthetic Polynucleotide
tatttcagaaaacgccga

SEQ ID NO: 10100 - DNA, 18 bp, Artificial Sequence
  Synthetic Polynucleotide
ggacacttcacctgatag

SEQ ID NO: 10101 - DNA, 17 bp, Artificial Sequence
  Synthetic Polynucleotide
gtacgcttctcttgctg

SEQ ID NO: 10102 - DNA, 18 bp, Artificial Sequence
  Synthetic Polynucleotide
tacttccactgtaacacc

SEQ ID NO: 10103 - DNA, 17 bp, Artificial Sequence
  Synthetic Polynucleotide
gtccaccaatgctaata

SEQ ID NO: 10104 - DNA, 18 bp, Artificial Sequence
  Synthetic Polynucleotide
ccaccacttgatctacca

SEQ ID NO: 10105 - DNA, 18 bp, Artificial Sequence
  Synthetic Polynucleotide
ccaccgactccgcatcca

SEQ ID NO: 10106 - DNA, 17 bp, Artificial Sequence
  Synthetic Polynucleotide
aattccccactgagcct

SEQ ID NO: 10107 - DNA, 17 bp, Artificial Sequence
  Synthetic Polynucleotide
aatatgcgtgccaccta

SEQ ID NO: 10108 - DNA, 17 bp, Artificial Sequence
  Synthetic Polynucleotide
gccatcccattgtcctt

SEQ ID NO: 10109 - DNA, 18 bp, Artificial Sequence
  Synthetic Polynucleotide
tgctttatgcctcttagc

SEQ ID NO: 10110 - DNA, 18 bp, Artificial Sequence
  Synthetic Polynucleotide
ctggtgacatactcaagc

SEQ ID NO: 10111 - DNA, 18 bp, Artificial Sequence
  Synthetic Polynucleotide
ccccaaaagcctcattga

SEQ ID NO: 10112 - DNA, 18 bp, Artificial Sequence
  Synthetic Polynucleotide
catctcggatgtagttcc

SEQ ID NO: 10113 - DNA, 17 bp, Artificial Sequence
  Synthetic Polynucleotide
ctctcatggttgagacc

SEQ ID NO: 10114 - DNA, 17 bp, Artificial Sequence
  Synthetic Polynucleotide
ccctctccccaatcttt

SEQ ID NO: 10115 - DNA, 17 bp, Artificial Sequence
  Synthetic Polynucleotide
gcatcaataccagctta

SEQ ID NO: 10116 - DNA, 17 bp, Artificial Sequence
  Synthetic Polynucleotide
cggtacattctcctcca

SEQ ID NO: 10117 - DNA, 17 bp, Artificial Sequence
  Synthetic Polynucleotide
acatacggacgatcaag

SEQ ID NO: 10118 - DNA, 17 bp, Artificial Sequence
  Synthetic Polynucleotide
gtgattgcctcaagcct

SEQ ID NO: 10119 - DNA, 18 bp, Artificial Sequence
  Synthetic Polynucleotide
gttcacgatcaagacaga

SEQ ID NO: 10120 - DNA, 18 bp, Artificial Sequence
  Synthetic Polynucleotide
tgatccctaagctcccta

SEQ ID NO: 10121 - DNA, 17 bp, Artificial Sequence
  Synthetic Polynucleotide
tgagagaaaggtcctgg

SEQ ID NO: 10122 - DNA, 17 bp, Artificial Sequence
  Synthetic Polynucleotide
tacctgatgttctttgc

SEQ ID NO: 10123 - DNA, 18 bp, Artificial Sequence
  Synthetic Polynucleotide
gaaacagcaaggaaacag

SEQ ID NO: 10124 - DNA, 17 bp, Artificial Sequence
  Synthetic Polynucleotide
tattgcagcttcaacag

SEQ ID NO: 10125 - DNA, 18 bp, Artificial Sequence
  Synthetic Polynucleotide
tgtctgtacttcccaaaa

SEQ ID NO: 10126 - DNA, 17 bp, Artificial Sequence
  Synthetic Polynucleotide
atttcatgtgcagctct

SEQ ID NO: 10127 - DNA, 18 bp, Artificial Sequence
  Synthetic Polynucleotide
gcaagtgacccttattct

SEQ ID NO: 10128 - DNA, 18 bp, Artificial Sequence
  Synthetic Polynucleotide
taaagacaacactgcttt

SEQ ID NO: 10129 - DNA, 17 bp, Artificial Sequence
  Synthetic Polynucleotide
atccagcttccatcaaa

SEQ ID NO: 10130 - DNA, 18 bp, Artificial Sequence
  Synthetic Polynucleotide
tttggtgagtcctgtagt

SEQ ID NO: 10131 - DNA, 17 bp, Artificial Sequence
  Synthetic Polynucleotide
gcatcctcaaatctggc

SEQ ID NO: 10132 - DNA, 17 bp, Artificial Sequence
  Synthetic Polynucleotide
tcgcttcaatagtccac

SEQ ID NO: 10133 - DNA, 17 bp, Artificial Sequence
  Synthetic Polynucleotide
catgctccaccttacat

SEQ ID NO: 10134 - DNA, 18 bp, Artificial Sequence
  Synthetic Polynucleotide
accaactacccttctttg

SEQ ID NO: 10135 - DNA, 18 bp, Artificial Sequence
  Synthetic Polynucleotide
aattaccactcgatccag

SEQ ID NO: 10136 - DNA, 18 bp, Artificial Sequence
  Synthetic Polynucleotide
tgctagtccccagaaatt

SEQ ID NO: 10137 - DNA, 17 bp, Artificial Sequence
  Synthetic Polynucleotide
cgttcccatcaactgta

SEQ ID NO: 10138 - DNA, 18 bp, Artificial Sequence
  Synthetic Polynucleotide
tgcatcttcccaactgcc

SEQ ID NO: 10139 - DNA, 18 bp, Artificial Sequence
  Synthetic Polynucleotide
ctcccgaatatgcccaag

SEQ ID NO: 10140 - DNA, 18 bp, Artificial Sequence
  Synthetic Polynucleotide
atcaaatcctagcctccc

SEQ ID NO: 10141 - DNA, 18 bp, Artificial Sequence
  Synthetic Polynucleotide
caacactgaatccacgat

SEQ ID NO: 10142 - DNA, 17 bp, Artificial Sequence
  Synthetic Polynucleotide
tcatcaagcctttgtgc

SEQ ID NO: 10143 - DNA, 18 bp, Artificial Sequence
  Synthetic Polynucleotide
accatctgacaacaactt

SEQ ID NO: 10144 - DNA, 17 bp, Artificial Sequence
  Synthetic Polynucleotide
tcaataccacccatagg

SEQ ID NO: 10145 - DNA, 18 bp, Artificial Sequence
  Synthetic Polynucleotide
gacaagaaaccacaaaca

SEQ ID NO: 10146 - DNA, 18 bp, Artificial Sequence
  Synthetic Polynucleotide
cttcagcggtcccatcat

SEQ ID NO: 10147 - DNA, 17 bp, Artificial Sequence
  Synthetic Polynucleotide
gatgagactcgatctgc

SEQ ID NO: 10148 - DNA, 17 bp, Artificial Sequence
  Synthetic Polynucleotide
ggaccccacatatccac

SEQ ID NO: 10149 - DNA, 18 bp, Artificial Sequence
  Synthetic Polynucleotide
tcgcccttaaagagattt

SEQ ID NO: 10150 - DNA, 17 bp, Artificial Sequence
  Synthetic Polynucleotide
ggtgaagacacccttca

SEQ ID NO: 10151 - DNA, 17 bp, Artificial Sequence
  Synthetic Polynucleotide
caaatgcagctacaacg

SEQ ID NO: 10152 - DNA, 18 bp, Artificial Sequence
  Synthetic Polynucleotide
acctcttcgaatttgtca

SEQ ID NO: 10153 - DNA, 17 bp, Artificial Sequence
  Synthetic Polynucleotide
atcctttggtcatcccg

SEQ ID NO: 10154 - DNA, 18 bp, Artificial Sequence
  Synthetic Polynucleotide
cttcctcctcttccaatg

SEQ ID NO: 10155 - DNA, 18 bp, Artificial Sequence
  Synthetic Polynucleotide
caaagctaaagtccctca

SEQ ID NO: 10156 - DNA, 18 bp, Artificial Sequence
  Synthetic Polynucleotide
taaccccattttctttgg

SEQ ID NO: 10157 - DNA, 18 bp, Artificial Sequence
  Synthetic Polynucleotide
tctcctgatcacacccaa

SEQ ID NO: 10158 - DNA, 18 bp, Artificial Sequence
  Synthetic Polynucleotide
ccacagcatcattgacaa

SEQ ID NO: 10159 - DNA, 18 bp, Artificial Sequence
  Synthetic Polynucleotide
attcactccagcaagctc

SEQ ID NO: 10160 - DNA, 18 bp, Artificial Sequence
  Synthetic Polynucleotide
agcccaagagtacactgt

SEQ ID NO: 10161 - DNA, 18 bp, Artificial Sequence
  Synthetic Polynucleotide
gactgaccccacgaatca

SEQ ID NO: 10162 - DNA, 18 bp, Artificial Sequence
  Synthetic Polynucleotide
tgccctgccccataagct

SEQ ID NO: 10163 - DNA, 17 bp, Artificial Sequence
  Synthetic Polynucleotide
tggtgccctcattttca

SEQ ID NO: 10164 - DNA, 17 bp, Artificial Sequence
  Synthetic Polynucleotide
tatcccacttcctacac

SEQ ID NO: 10165 - DNA, 18 bp, Artificial Sequence
  Synthetic Polynucleotide
cctgatttaaacccggta

SEQ ID NO: 10166 - DNA, 18 bp, Artificial Sequence
  Synthetic Polynucleotide
gcttgaaccactcattcg

SEQ ID NO: 10167 - DNA, 17 bp, Artificial Sequence
  Synthetic Polynucleotide
gcgcttgtataccgagt

SEQ ID NO: 10168 - DNA, 18 bp, Artificial Sequence
  Synthetic Polynucleotide
agcagctcccgttgtgaa

SEQ ID NO: 10169 - DNA, 17 bp, Artificial Sequence
  Synthetic Polynucleotide
tatcgggcagtttggtg

SEQ ID NO: 10170 - DNA, 17 bp, Artificial Sequence
  Synthetic Polynucleotide
gcatctggaacaacaaa

SEQ ID NO: 10171 - DNA, 17 bp, Artificial Sequence
  Synthetic Polynucleotide
ttctgtacgctccaagt

SEQ ID NO: 10172 - DNA, 17 bp, Artificial Sequence
  Synthetic Polynucleotide
aagatgtgagcagggcg

SEQ ID NO: 10173 - DNA, 17 bp, Artificial Sequence
  Synthetic Polynucleotide
ccgaatcactcactggt

SEQ ID NO: 10174 - DNA, 18 bp, Artificial Sequence
  Synthetic Polynucleotide
aacattcttccatcaggc

SEQ ID NO: 10175 - DNA, 17 bp, Artificial Sequence
  Synthetic Polynucleotide
accgcttgattggcatg

SEQ ID NO: 10176 - DNA, 17 bp, Artificial Sequence
  Synthetic Polynucleotide
caagtgaaggtagggta

SEQ ID NO: 10177 - DNA, 18 bp, Artificial Sequence
  Synthetic Polynucleotide
ggaccactagtccccttc

SEQ ID NO: 10178 - DNA, 17 bp, Artificial Sequence
  Synthetic Polynucleotide
acagagtcgaggacgaa

SEQ ID NO: 10179 - DNA, 18 bp, Artificial Sequence
  Synthetic Polynucleotide
ttcgacattctgaacgct

SEQ ID NO: 10180 - DNA, 18 bp, Artificial Sequence
  Synthetic Polynucleotide
gaaggtaggcatttggca

SEQ ID NO: 10181 - DNA, 17 bp, Artificial Sequence
  Synthetic Polynucleotide
ctcgaaccttttcaacc

SEQ ID NO: 10182 - DNA, 18 bp, Artificial Sequence
  Synthetic Polynucleotide
ccttgaggtagtcccatg

SEQ ID NO: 10183 - DNA, 18 bp, Artificial Sequence
  Synthetic Polynucleotide
tacttttggcacagttta

SEQ ID NO: 10184 - DNA, 18 bp, Artificial Sequence
  Synthetic Polynucleotide
cggtgtcttcatcagcat

SEQ ID NO: 10185 - DNA, 17 bp, Artificial Sequence
  Synthetic Polynucleotide
actagaccatcattggc

SEQ ID NO: 10186 - DNA, 18 bp, Artificial Sequence
  Synthetic Polynucleotide
gtttctgtattacggcac

SEQ ID NO: 10187 - DNA, 18 bp, Artificial Sequence
  Synthetic Polynucleotide
tgtcattggcacggcatg

SEQ ID NO: 10188 - DNA, 18 bp, Artificial Sequence
  Synthetic Polynucleotide
tgtcttgtaccatttcga

SEQ ID NO: 10189 - DNA, 17 bp, Artificial Sequence
  Synthetic Polynucleotide
cgacgaacacacgctct

SEQ ID NO: 10190 - DNA, 18 bp, Artificial Sequence
  Synthetic Polynucleotide
cggaggaatcattcagca

SEQ ID NO: 10191 - DNA, 18 bp, Artificial Sequence
  Synthetic Polynucleotide
ctttccgctactctcctc

SEQ ID NO: 10192 - DNA, 17 bp, Artificial Sequence
  Synthetic Polynucleotide
cgatctccatccatcgt

SEQ ID NO: 10193 - DNA, 18 bp, Artificial Sequence
  Synthetic Polynucleotide
gtgaagtatctctccctg

SEQ ID NO: 10194 - DNA, 18 bp, Artificial Sequence
  Synthetic Polynucleotide
ggttgaccgctttctcgt

SEQ ID NO: 10195 - DNA, 18 bp, Artificial Sequence
  Synthetic Polynucleotide
gaataggcatttctgcaa

SEQ ID NO: 10196 - DNA, 18 bp, Artificial Sequence
  Synthetic Polynucleotide
aaagagtccgtttgaaga

SEQ ID NO: 10197 - DNA, 17 bp, Artificial Sequence
  Synthetic Polynucleotide
cctacatccccaacttc

SEQ ID NO: 10198 - DNA, 17 bp, Artificial Sequence
  Synthetic Polynucleotide
aggcatatatccatgcg

SEQ ID NO: 10199 - DNA, 18 bp, Artificial Sequence
  Synthetic Polynucleotide
cgaaaaccgcttcttagt

SEQ ID NO: 10200 - DNA, 18 bp, Artificial Sequence
  Synthetic Polynucleotide
aacatcgtaggtcgtttc

SEQ ID NO: 10201 - DNA, 17 bp, Artificial Sequence
  Synthetic Polynucleotide
aaattgatccccgcatc

SEQ ID NO: 10202 - DNA, 18 bp, Artificial Sequence
  Synthetic Polynucleotide
gggttgtcattagcatcg

SEQ ID NO: 10203 - DNA, 18 bp, Artificial Sequence
  Synthetic Polynucleotide
tatagacccatctctcgt

SEQ ID NO: 10204 - DNA, 17 bp, Artificial Sequence
  Synthetic Polynucleotide
tctaggcacagcacaaa

SEQ ID NO: 10205 - DNA, 18 bp, Artificial Sequence
  Synthetic Polynucleotide
tcatcgaattttcccagc

SEQ ID NO: 10206 - DNA, 17 bp, Artificial Sequence
  Synthetic Polynucleotide
caaattggcagttgtgg

SEQ ID NO: 10207 - DNA, 17 bp, Artificial Sequence
  Synthetic Polynucleotide
cgcatccgcagtctgtg

SEQ ID NO: 10208 - DNA, 18 bp, Artificial Sequence
  Synthetic Polynucleotide
gtgtctgaggcttgaaaa

SEQ ID NO: 10209 - DNA, 17 bp, Artificial Sequence
  Synthetic Polynucleotide
aaggctttccccacgaa

SEQ ID NO: 10210 - DNA, 18 bp, Artificial Sequence
  Synthetic Polynucleotide
cgcattccaagagaaata

SEQ ID NO: 10211 - DNA, 17 bp, Artificial Sequence
  Synthetic Polynucleotide
tcctggaacaaaacgtt

SEQ ID NO: 10212 - DNA, 18 bp, Artificial Sequence
  Synthetic Polynucleotide
agagtacgcttccatagg

SEQ ID NO: 10213 - DNA, 18 bp, Artificial Sequence
  Synthetic Polynucleotide
cgaagtttctccaacttt

SEQ ID NO: 10214 - DNA, 18 bp, Artificial Sequence
  Synthetic Polynucleotide
ccagtcgcagcactcctg

SEQ ID NO: 10215 - DNA, 18 bp, Artificial Sequence
  Synthetic Polynucleotide
cgacgctcccagtttctt

SEQ ID NO: 10216 - DNA, 18 bp, Artificial Sequence
  Synthetic Polynucleotide
ggcatcttctaataccgt

SEQ ID NO: 10217 - DNA, 18 bp, Artificial Sequence
  Synthetic Polynucleotide
ctcaacagctagtccatg

SEQ ID NO: 10218 - DNA, 17 bp, Artificial Sequence
  Synthetic Polynucleotide
ctctccatcatcatccc

SEQ ID NO: 10219 - DNA, 18 bp, Artificial Sequence
  Synthetic Polynucleotide
aggctccttgtcaatatt

SEQ ID NO: 10220 - DNA, 18 bp, Artificial Sequence
  Synthetic Polynucleotide
tcacccataggtagaccc

SEQ ID NO: 10221 - DNA, 17 bp, Artificial Sequence
  Synthetic Polynucleotide
ggtctgtctgaggctac

SEQ ID NO: 10222 - DNA, 18 bp, Artificial Sequence
  Synthetic Polynucleotide
caacagtctcttttacga

SEQ ID NO: 10223 - DNA, 17 bp, Artificial Sequence
  Synthetic Polynucleotide
ctcacgcagcaaaatca

SEQ ID NO: 10224 - DNA, 18 bp, Artificial Sequence
  Synthetic Polynucleotide
gagcagcactcctaacac

SEQ ID NO: 10225 - DNA, 18 bp, Artificial Sequence
  Synthetic Polynucleotide
aagtcagtttctgtttcg

SEQ ID NO: 10226 - DNA, 17 bp, Artificial Sequence
  Synthetic Polynucleotide
gttggttctccttggtc

SEQ ID NO: 10227 - DNA, 18 bp, Artificial Sequence
  Synthetic Polynucleotide
tgtgcttggttggtaaag

SEQ ID NO: 10228 - DNA, 17 bp, Artificial Sequence
  Synthetic Polynucleotide
ttccacccaatcctggt

SEQ ID NO: 10229 - DNA, 18 bp, Artificial Sequence
  Synthetic Polynucleotide
ctagccgttggtcacgcc

SEQ ID NO: 10230 - DNA, 18 bp, Artificial Sequence
  Synthetic Polynucleotide
ccccagttgttgttgatg

SEQ ID NO: 10231 - DNA, 17 bp, Artificial Sequence
  Synthetic Polynucleotide
attggcattgcgattcc

SEQ ID NO: 10232 - DNA, 17 bp, Artificial Sequence
  Synthetic Polynucleotide
tttgcatctgtagctgt

SEQ ID NO: 10233 - DNA, 18 bp, Artificial Sequence
  Synthetic Polynucleotide
caaagagtatcagcaagg

SEQ ID NO: 10234 - DNA, 18 bp, Artificial Sequence
  Synthetic Polynucleotide
agaaggtcaaaggtcagt

SEQ ID NO: 10235 - DNA, 18 bp, Artificial Sequence
  Synthetic Polynucleotide
actgccgtcgtcgtcgtc

SEQ ID NO: 10236 - DNA, 18 bp, Artificial Sequence
  Synthetic Polynucleotide
ttgccccgattcaaatat

SEQ ID NO: 10237 - DNA, 17 bp, Artificial Sequence
  Synthetic Polynucleotide
ggctcccgccagatttt

SEQ ID NO: 10238 - DNA, 18 bp, Artificial Sequence
  Synthetic Polynucleotide
gccttattcttccttgga

SEQ ID NO: 10239 - DNA, 17 bp, Artificial Sequence
  Synthetic Polynucleotide
aactcctatcgaacgag

SEQ ID NO: 10240 - DNA, 18 bp, Artificial Sequence
  Synthetic Polynucleotide
tctcaggtctgcctctat

SEQ ID NO: 10241 - DNA, 18 bp, Artificial Sequence
  Synthetic Polynucleotide
tatgtgcatggttagtta

SEQ ID NO: 10242 - DNA, 18 bp, Artificial Sequence
  Synthetic Polynucleotide
agcatccaccattctttg

SEQ ID NO: 10243 - DNA, 17 bp, Artificial Sequence
  Synthetic Polynucleotide
actttggagactgcgaa

SEQ ID NO: 10244 - DNA, 18 bp, Artificial Sequence
  Synthetic Polynucleotide
gcataccactgtcgtgtg

SEQ ID NO: 10245 - DNA, 18 bp, Artificial Sequence
  Synthetic Polynucleotide
ccggaaacagtagacaag

SEQ ID NO: 10246 - DNA, 17 bp, Artificial Sequence
  Synthetic Polynucleotide
caccagatcaccatctt

SEQ ID NO: 10247 - DNA, 18 bp, Artificial Sequence
  Synthetic Polynucleotide
gaaccccaattctgacgc

SEQ ID NO: 10248 - DNA, 18 bp, Artificial Sequence
  Synthetic Polynucleotide
ctgcatcatcatccagtc

SEQ ID NO: 10249 - DNA, 18 bp, Artificial Sequence
  Synthetic Polynucleotide
caaagaacatagctccta

SEQ ID NO: 10250 - DNA, 18 bp, Artificial Sequence
  Synthetic Polynucleotide
ctgtgaatgagcgaacat

SEQ ID NO: 10251 - DNA, 17 bp, Artificial Sequence
  Synthetic Polynucleotide
aattggcattgcgattc

SEQ ID NO: 10252 - DNA, 17 bp, Artificial Sequence
  Synthetic Polynucleotide
caagcctcatgtcggta

SEQ ID NO: 10253 - DNA, 17 bp, Artificial Sequence
  Synthetic Polynucleotide
tcacccacaaatgtcaa

SEQ ID NO: 10254 - DNA, 17 bp, Artificial Sequence
  Synthetic Polynucleotide
tcccttccagttcattt

SEQ ID NO: 10255 - DNA, 18 bp, Artificial Sequence
  Synthetic Polynucleotide
atactacccagatttcga

SEQ ID NO: 10256 - DNA, 18 bp, Artificial Sequence
  Synthetic Polynucleotide
gtttcttggatttcccac

SEQ ID NO: 10257 - DNA, 18 bp, Artificial Sequence
  Synthetic Polynucleotide
ggtgagtacaaaatgagc

SEQ ID NO: 10258 - DNA, 17 bp, Artificial Sequence
  Synthetic Polynucleotide
gcatttacccctcgtat

SEQ ID NO: 10259 - DNA, 17 bp, Artificial Sequence
  Synthetic Polynucleotide
attatctgccgtaccgt

SEQ ID NO: 10260 - DNA, 17 bp, Artificial Sequence
  Synthetic Polynucleotide
cgagtttggtccagtag

SEQ ID NO: 10261 - DNA, 18 bp, Artificial Sequence
  Synthetic Polynucleotide
tatttggttctatggacc

SEQ ID NO: 10262 - DNA, 17 bp, Artificial Sequence
  Synthetic Polynucleotide
ccaccctagcctatcgg

SEQ ID NO: 10263 - DNA, 17 bp, Artificial Sequence
  Synthetic Polynucleotide
atccccgtgtgtcccct

SEQ ID NO: 10264 - DNA, 18 bp, Artificial Sequence
  Synthetic Polynucleotide
ccactagttgtttgcctg

SEQ ID NO: 10265 - DNA, 18 bp, Artificial Sequence
  Synthetic Polynucleotide
ggtgcaagtagattacca

SEQ ID NO: 10266 - DNA, 18 bp, Artificial Sequence
  Synthetic Polynucleotide
accagagtcattagcaag

SEQ ID NO: 10267 - DNA, 17 bp, Artificial Sequence
  Synthetic Polynucleotide
accaccccgtatattgc

SEQ ID NO: 10268 - DNA, 18 bp, Artificial Sequence
  Synthetic Polynucleotide
gccttgtagcccaatctg

SEQ ID NO: 10269 - DNA, 17 bp, Artificial Sequence
  Synthetic Polynucleotide
caaaagccttgtgtgca

SEQ ID NO: 10270 - DNA, 18 bp, Artificial Sequence
  Synthetic Polynucleotide
attcctagcccattctgc

SEQ ID NO: 10271 - DNA, 17 bp, Artificial Sequence
  Synthetic Polynucleotide
cgccagtaataagcgaa

SEQ ID NO: 10272 - DNA, 18 bp, Artificial Sequence
  Synthetic Polynucleotide
gagtgcatcactacgcct

SEQ ID NO: 10273 - DNA, 17 bp, Artificial Sequence
  Synthetic Polynucleotide
tactgcctcccactaca

SEQ ID NO: 10274 - DNA, 18 bp, Artificial Sequence
  Synthetic Polynucleotide
accagcatctaaacgaaa

SEQ ID NO: 10275 - DNA, 18 bp, Artificial Sequence
  Synthetic Polynucleotide
gctaaagcgataattgcg

SEQ ID NO: 10276 - DNA, 18 bp, Artificial Sequence
  Synthetic Polynucleotide
gtcttccttgtagtcccc

SEQ ID NO: 10277 - DNA, 17 bp, Artificial Sequence
  Synthetic Polynucleotide
cagagtcaaagcctaga

SEQ ID NO: 10278 - DNA, 18 bp, Artificial Sequence
  Synthetic Polynucleotide
atcatcgagagcatcagg

SEQ ID NO: 10279 - DNA, 17 bp, Artificial Sequence
  Synthetic Polynucleotide
tgcgattccattgatct

SEQ ID NO: 10280 - DNA, 17 bp, Artificial Sequence
  Synthetic Polynucleotide
ataccgcctagataacg

SEQ ID NO: 10281 - DNA, 17 bp, Artificial Sequence
  Synthetic Polynucleotide
attcaccccaatcagga

SEQ ID NO: 10282 - DNA, 17 bp, Artificial Sequence
  Synthetic Polynucleotide
ttcaaccaccccaccaa

SEQ ID NO: 10283 - DNA, 17 bp, Artificial Sequence
  Synthetic Polynucleotide
tgaagtaagagcccttg

SEQ ID NO: 10284 - DNA, 17 bp, Artificial Sequence
  Synthetic Polynucleotide
cgacacagatgaagtcg

SEQ ID NO: 10285 - DNA, 17 bp, Artificial Sequence
  Synthetic Polynucleotide
caccaccaccaccgcca

SEQ ID NO: 10286 - DNA, 18 bp, Artificial Sequence
  Synthetic Polynucleotide
aacgtttacgctgaaacc

SEQ ID NO: 10287 - DNA, 17 bp, Artificial Sequence
  Synthetic Polynucleotide
gcgtatcaagtcaatgc

SEQ ID NO: 10288 - DNA, 18 bp, Artificial Sequence
  Synthetic Polynucleotide
ccaaagtagtcggttccg

SEQ ID NO: 10289 - DNA, 17 bp, Artificial Sequence
  Synthetic Polynucleotide
tccggcccctgaatgcg

SEQ ID NO: 10290 - DNA, 18 bp, Artificial Sequence
  Synthetic Polynucleotide
cgcaggtaaagtgatctg

SEQ ID NO: 10291 - DNA, 17 bp, Artificial Sequence
  Synthetic Polynucleotide
atcctctcctttgcacg

SEQ ID NO: 10292 - DNA, 17 bp, Artificial Sequence
  Synthetic Polynucleotide
aaaacctaaatgcccct

SEQ ID NO: 10293 - DNA, 18 bp, Artificial Sequence
  Synthetic Polynucleotide
ggctacgggtgaaacctc

SEQ ID NO: 10294 - DNA, 18 bp, Artificial Sequence
  Synthetic Polynucleotide
gagcatgtcctgtccttt

SEQ ID NO: 10295 - DNA, 17 bp, Artificial Sequence
  Synthetic Polynucleotide
cctgtcgctttgaaagt

SEQ ID NO: 10296 - DNA, 17 bp, Artificial Sequence
  Synthetic Polynucleotide
ggtcgctacagacgttg

SEQ ID NO: 10297 - DNA, 18 bp, Artificial Sequence
  Synthetic Polynucleotide
tgaaggctacgatagtgc

SEQ ID NO: 10298 - DNA, 18 bp, Artificial Sequence
  Synthetic Polynucleotide
aggaattggtcgagttgg

SEQ ID NO: 10299 - DNA, 17 bp, Artificial Sequence
  Synthetic Polynucleotide
atcagccccatccaata

SEQ ID NO: 10300 - DNA, 17 bp, Artificial Sequence
  Synthetic Polynucleotide
tcacagcagtagatggt

SEQ ID NO: 10301 - DNA, 18 bp, Artificial Sequence
  Synthetic Polynucleotide
gaggcggtcctctctggc

SEQ ID NO: 10302 - DNA, 17 bp, Artificial Sequence
  Synthetic Polynucleotide
ctttgtgtggtcgctac

SEQ ID NO: 10303 - DNA, 18 bp, Artificial Sequence
  Synthetic Polynucleotide
ccaggctaagagaagtag

SEQ ID NO: 10304 - DNA, 17 bp, Artificial Sequence
  Synthetic Polynucleotide
cctgttaccaggtgttg

SEQ ID NO: 10305 - DNA, 18 bp, Artificial Sequence
  Synthetic Polynucleotide
gagagtccctttcccagc

SEQ ID NO: 10306 - DNA, 18 bp, Artificial Sequence
  Synthetic Polynucleotide
tgggtgttgtacatggca

SEQ ID NO: 10307 - DNA, 17 bp, Artificial Sequence
  Synthetic Polynucleotide
tcctccgagaaaaccca

SEQ ID NO: 10308 - DNA, 18 bp, Artificial Sequence
  Synthetic Polynucleotide
gctacccttaatctctcg

SEQ ID NO: 10309 - DNA, 17 bp, Artificial Sequence
  Synthetic Polynucleotide
ccttgccccttgacgca

SEQ ID NO: 10310 - DNA, 17 bp, Artificial Sequence
  Synthetic Polynucleotide
agaggctagtgttacca

SEQ ID NO: 10311 - DNA, 17 bp, Artificial Sequence
  Synthetic Polynucleotide
gtcccactcttcacagg

SEQ ID NO: 10312 - DNA, 17 bp, Artificial Sequence
  Synthetic Polynucleotide
tgctcgtgttaactagg

SEQ ID NO: 10313 - DNA, 18 bp, Artificial Sequence
  Synthetic Polynucleotide
ttcggtttgcatcttttg

SEQ ID NO: 10314 - DNA, 17 bp, Artificial Sequence
  Synthetic Polynucleotide
gaaacccttaaaaggcc

SEQ ID NO: 10315 - DNA, 18 bp, Artificial Sequence
  Synthetic Polynucleotide
ccttcttgtaaggcactc

SEQ ID NO: 10316 - DNA, 17 bp, Artificial Sequence
  Synthetic Polynucleotide
ttgcaggcttgagaaac

SEQ ID NO: 10317 - DNA, 18 bp, Artificial Sequence
  Synthetic Polynucleotide
tgatgtgttggtcgtttg

SEQ ID NO: 10318 - DNA, 17 bp, Artificial Sequence
  Synthetic Polynucleotide
acccaaagtagtcggtc

SEQ ID NO: 10319 - DNA, 18 bp, Artificial Sequence
  Synthetic Polynucleotide
gtgcttctaagtttcggg

SEQ ID NO: 10320 - DNA, 17 bp, Artificial Sequence
  Synthetic Polynucleotide
cctgttttcccctccct

SEQ ID NO: 10321 - DNA, 17 bp, Artificial Sequence
  Synthetic Polynucleotide
ccggatcatcaagttgg

SEQ ID NO: 10322 - DNA, 17 bp, Artificial Sequence
  Synthetic Polynucleotide
catgagtccattcgttg

SEQ ID NO: 10323 - DNA, 17 bp, Artificial Sequence
  Synthetic Polynucleotide
gatccagcagtgttctt

SEQ ID NO: 10324 - DNA, 18 bp, Artificial Sequence
  Synthetic Polynucleotide
gcacattccagtgttgct

SEQ ID NO: 10325 - DNA, 17 bp, Artificial Sequence
  Synthetic Polynucleotide
caaagtagttggtccca

SEQ ID NO: 10326 - DNA, 17 bp, Artificial Sequence
  Synthetic Polynucleotide
tgttcccactcactcca

SEQ ID NO: 10327 - DNA, 17 bp, Artificial Sequence
  Synthetic Polynucleotide
agcagatacattccgtc

SEQ ID NO: 10328 - DNA, 18 bp, Artificial Sequence
  Synthetic Polynucleotide
ctggttcgatggttgttc

SEQ ID NO: 10329 - DNA, 17 bp, Artificial Sequence
  Synthetic Polynucleotide
tgcagaattgcagtttg

SEQ ID NO: 10330 - DNA, 18 bp, Artificial Sequence
  Synthetic Polynucleotide
tggccctctctcctccag

SEQ ID NO: 10331 - DNA, 18 bp, Artificial Sequence
  Synthetic Polynucleotide
agcttcatcatcttccac

SEQ ID NO: 10332 - DNA, 18 bp, Artificial Sequence
  Synthetic Polynucleotide
gcaagattttattgcccc

SEQ ID NO: 10333 - DNA, 18 bp, Artificial Sequence
  Synthetic Polynucleotide
tcatcctcaaatcagaca

SEQ ID NO: 10334 - DNA, 18 bp, Artificial Sequence
  Synthetic Polynucleotide
tggattgaatctcccaat

SEQ ID NO: 10335 - DNA, 17 bp, Artificial Sequence
  Synthetic Polynucleotide
ccgagatgttggtgatt

SEQ ID NO: 10336 - DNA, 17 bp, Artificial Sequence
  Synthetic Polynucleotide
ctgtccctcctcttcac

SEQ ID NO: 10337 - DNA, 18 bp, Artificial Sequence
  Synthetic Polynucleotide
gcatcatttccacaggtg

SEQ ID NO: 10338 - DNA, 18 bp, Artificial Sequence
  Synthetic Polynucleotide
catggtagttgtgtaggt

SEQ ID NO: 10339 - DNA, 18 bp, Artificial Sequence
  Synthetic Polynucleotide
ccccttgcttcatacttg

SEQ ID NO: 10340 - DNA, 17 bp, Artificial Sequence
  Synthetic Polynucleotide
cgagttgtgtgttatgc

SEQ ID NO: 10341 - DNA, 18 bp, Artificial Sequence
  Synthetic Polynucleotide
ccgttatctagttcggtt

SEQ ID NO: 10342 - DNA, 17 bp, Artificial Sequence
  Synthetic Polynucleotide
tgcatcatatccttggc

SEQ ID NO: 10343 - DNA, 17 bp, Artificial Sequence
  Synthetic Polynucleotide
gcacattcccctaagta

SEQ ID NO: 10344 - DNA, 17 bp, Artificial Sequence
  Synthetic Polynucleotide
ctaccctcccttccaca

SEQ ID NO: 10345 - DNA, 18 bp, Artificial Sequence
  Synthetic Polynucleotide
ctccagcattgattcatc

SEQ ID NO: 10346 - DNA, 18 bp, Artificial Sequence
  Synthetic Polynucleotide
aatacagtccagtccacc

SEQ ID NO: 10347 - DNA, 17 bp, Artificial Sequence
  Synthetic Polynucleotide
tgtcacggtattgtcgt

SEQ ID NO: 10348 - DNA, 18 bp, Artificial Sequence
  Synthetic Polynucleotide
gcagcttcagttcagaaa

SEQ ID NO: 10349 - DNA, 18 bp, Artificial Sequence
  Synthetic Polynucleotide
gagcccctataatttgca

SEQ ID NO: 10350 - DNA, 17 bp, Artificial Sequence
  Synthetic Polynucleotide
aacagttgaccctcttc

SEQ ID NO: 10351 - DNA, 17 bp, Artificial Sequence
  Synthetic Polynucleotide
gtgtgtgtcagtgatct

SEQ ID NO: 10352 - DNA, 17 bp, Artificial Sequence
  Synthetic Polynucleotide
ccgtacatttcagcagc

SEQ ID NO: 10353 - DNA, 18 bp, Artificial Sequence
  Synthetic Polynucleotide
atttgtcctttgttgacc

SEQ ID NO: 10354 - DNA, 18 bp, Artificial Sequence
  Synthetic Polynucleotide
taattgctatggttcctg

SEQ ID NO: 10355 - DNA, 18 bp, Artificial Sequence
  Synthetic Polynucleotide
gcttcattgatgagtgta

SEQ ID NO: 10356 - DNA, 17 bp, Artificial Sequence
  Synthetic Polynucleotide
gtaaaggtcaaatggcc

SEQ ID NO: 10357 - DNA, 17 bp, Artificial Sequence
  Synthetic Polynucleotide
acgaccagtcttgactc

SEQ ID NO: 10358 - DNA, 18 bp, Artificial Sequence
  Synthetic Polynucleotide
cgagattatccgtaagct

SEQ ID NO: 10359 - DNA, 18 bp, Artificial Sequence
  Synthetic Polynucleotide
ttcgatttcgtctactgc

SEQ ID NO: 10360 - DNA, 18 bp, Artificial Sequence
  Synthetic Polynucleotide
gctcacgtctgctcagtg

SEQ ID NO: 10361 - DNA, 18 bp, Artificial Sequence
  Synthetic Polynucleotide
cgcacctgttcgacaatc

SEQ ID NO: 10362 - DNA, 18 bp, Artificial Sequence
  Synthetic Polynucleotide
tgacggttttcccttcga

SEQ ID NO: 10363 - DNA, 17 bp, Artificial Sequence
  Synthetic Polynucleotide
catcgtgtacgttgttg

SEQ ID NO: 10364 - DNA, 17 bp, Artificial Sequence
  Synthetic Polynucleotide
cagatcgccaactactg

SEQ ID NO: 10365 - DNA, 17 bp, Artificial Sequence
  Synthetic Polynucleotide
ccatagcttcctgcttg

SEQ ID NO: 10366 - DNA, 17 bp, Artificial Sequence
  Synthetic Polynucleotide
cagggttgatttcgagc

SEQ ID NO: 10367 - DNA, 18 bp, Artificial Sequence
  Synthetic Polynucleotide
gtttcttccaacttggtg

SEQ ID NO: 10368 - DNA, 18 bp, Artificial Sequence
  Synthetic Polynucleotide
tgtttgtgttgtagggta

SEQ ID NO: 10369 - DNA, 17 bp, Artificial Sequence
  Synthetic Polynucleotide
atcctgttcaatctgcc

SEQ ID NO: 10370 - DNA, 17 bp, Artificial Sequence
  Synthetic Polynucleotide
gactgaagaaccttgcc

SEQ ID NO: 10371 - DNA, 17 bp, Artificial Sequence
  Synthetic Polynucleotide
gatgtagccattcaggg

SEQ ID NO: 10372 - DNA, 17 bp, Artificial Sequence
  Synthetic Polynucleotide
gtgatgccgagaagtac

SEQ ID NO: 10373 - DNA, 17 bp, Artificial Sequence
  Synthetic Polynucleotide
agcacaattcacccgta

SEQ ID NO: 10374 - DNA, 18 bp, Artificial Sequence
  Synthetic Polynucleotide
tcttgatgctgccgctcg

SEQ ID NO: 10375 - DNA, 18 bp, Artificial Sequence
  Synthetic Polynucleotide
cagctcttgtattacgct

SEQ ID NO: 10376 - DNA, 17 bp, Artificial Sequence
  Synthetic Polynucleotide
atcctttctgacttccg

SEQ ID NO: 10377 - DNA, 18 bp, Artificial Sequence
  Synthetic Polynucleotide
atgtcattgccatagtta

SEQ ID NO: 10378 - DNA, 18 bp, Artificial Sequence
  Synthetic Polynucleotide
gcccttaattagcctctt

SEQ ID NO: 10379 - DNA, 17 bp, Artificial Sequence
  Synthetic Polynucleotide
tagccccaaagtgatag

SEQ ID NO: 10380 - DNA, 17 bp, Artificial Sequence
  Synthetic Polynucleotide
gagatgactctgaacga

SEQ ID NO: 10381 - DNA, 17 bp, Artificial Sequence
  Synthetic Polynucleotide
tttgtttcaccgcccaa

SEQ ID NO: 10382 - DNA, 18 bp, Artificial Sequence
  Synthetic Polynucleotide
tgatgactttccttggaa

SEQ ID NO: 10383 - DNA, 17 bp, Artificial Sequence
  Synthetic Polynucleotide
gaaacttcatgttcgcc

SEQ ID NO: 10384 - DNA, 18 bp, Artificial Sequence
  Synthetic Polynucleotide
cttccgccacaattcgcc

SEQ ID NO: 10385 - DNA, 18 bp, Artificial Sequence
  Synthetic Polynucleotide
cctttaccactgtgtccc

SEQ ID NO: 10386 - DNA, 17 bp, Artificial Sequence
  Synthetic Polynucleotide
tacccgtattatgctcc

SEQ ID NO: 10387 - DNA, 17 bp, Artificial Sequence
  Synthetic Polynucleotide
tgtcttgcccatctgtt

SEQ ID NO: 10388 - DNA, 18 bp, Artificial Sequence
  Synthetic Polynucleotide
aggttaccttgtacctga

SEQ ID NO: 10389 - DNA, 17 bp, Artificial Sequence
  Synthetic Polynucleotide
ttgtagtcgcaccgctc

SEQ ID NO: 10390 - DNA, 18 bp, Artificial Sequence
  Synthetic Polynucleotide
cagaccaccgccaactcg

SEQ ID NO: 10391 - DNA, 18 bp, Artificial Sequence
  Synthetic Polynucleotide
gcctcctaaaagacccgt

SEQ ID NO: 10392 - DNA, 17 bp, Artificial Sequence
  Synthetic Polynucleotide
ccatcctgccaatacat

SEQ ID NO: 10393 - DNA, 17 bp, Artificial Sequence
  Synthetic Polynucleotide
tgacgcactagctcaga

SEQ ID NO: 10394 - DNA, 17 bp, Artificial Sequence
  Synthetic Polynucleotide
gcagtcttgtcctcagt

SEQ ID NO: 10395 - DNA, 18 bp, Artificial Sequence
  Synthetic Polynucleotide
acgttagcctccgagact

SEQ ID NO: 10396 - DNA, 18 bp, Artificial Sequence
  Synthetic Polynucleotide
tgtctccttcgtgttcaa

SEQ ID NO: 10397 - DNA, 18 bp, Artificial Sequence
  Synthetic Polynucleotide
gtaaagccttagcctcta

SEQ ID NO: 10398 - DNA, 17 bp, Artificial Sequence
  Synthetic Polynucleotide
gttagcccctagcttag

SEQ ID NO: 10399 - DNA, 18 bp, Artificial Sequence
  Synthetic Polynucleotide
cgaactccttcaccagct

SEQ ID NO: 10400 - DNA, 17 bp, Artificial Sequence
  Synthetic Polynucleotide
gacctgctcccattcct

SEQ ID NO: 10401 - DNA, 18 bp, Artificial Sequence
  Synthetic Polynucleotide
tatcgtttctcctaaacc

SEQ ID NO: 10402 - DNA, 17 bp, Artificial Sequence
  Synthetic Polynucleotide
accgctgccaccattga

SEQ ID NO: 10403 - DNA, 18 bp, Artificial Sequence
  Synthetic Polynucleotide
tgtctactcctgaccgca

SEQ ID NO: 10404 - DNA, 17 bp, Artificial Sequence
  Synthetic Polynucleotide
tccaccatgccagatac

SEQ ID NO: 10405 - DNA, 17 bp, Artificial Sequence
  Synthetic Polynucleotide
catcctctgcttgctta

SEQ ID NO: 10406 - DNA, 18 bp, Artificial Sequence
  Synthetic Polynucleotide
gcgtgttaaagatctctc

SEQ ID NO: 10407 - DNA, 17 bp, Artificial Sequence
  Synthetic Polynucleotide
tccatgatttcgcctgg

SEQ ID NO: 10408 - DNA, 17 bp, Artificial Sequence
  Synthetic Polynucleotide
acattgccgcccgagtc

SEQ ID NO: 10409 - DNA, 17 bp, Artificial Sequence
  Synthetic Polynucleotide
ctatgacgcccgcccaa

SEQ ID NO: 10410 - DNA, 17 bp, Artificial Sequence
  Synthetic Polynucleotide
ccccatccgcccgctta

SEQ ID NO: 10411 - DNA, 17 bp, Artificial Sequence
  Synthetic Polynucleotide
gccgcccaactctatat

SEQ ID NO: 10412 - DNA, 17 bp, Artificial Sequence
  Synthetic Polynucleotide
cttggtcctcctgttac

SEQ ID NO: 10413 - DNA, 18 bp, Artificial Sequence
  Synthetic Polynucleotide
tcaaaagatgctttcaga

SEQ ID NO: 10414 - DNA, 18 bp, Artificial Sequence
  Synthetic Polynucleotide
aggttatttcccctttgc

SEQ ID NO: 10415 - DNA, 17 bp, Artificial Sequence
  Synthetic Polynucleotide
tttcacacccatcccat

SEQ ID NO: 10416 - DNA, 18 bp, Artificial Sequence
  Synthetic Polynucleotide
acacctgccgcttaacct

SEQ ID NO: 10417 - DNA, 18 bp, Artificial Sequence
  Synthetic Polynucleotide
gactccgattcttaaagc

SEQ ID NO: 10418 - DNA, 18 bp, Artificial Sequence
  Synthetic Polynucleotide
gttgcaatcctagcccgt

SEQ ID NO: 10419 - DNA, 17 bp, Artificial Sequence
  Synthetic Polynucleotide
aaatgccgaccttgaaa

SEQ ID NO: 10420 - DNA, 18 bp, Artificial Sequence
  Synthetic Polynucleotide
attgttacgtctgaaccc

SEQ ID NO: 10421 - DNA, 17 bp, Artificial Sequence
  Synthetic Polynucleotide
gcttcccactcatcgta

SEQ ID NO: 10422 - DNA, 17 bp, Artificial Sequence
  Synthetic Polynucleotide
tagcccctatttctgat

SEQ ID NO: 10423 - DNA, 18 bp, Artificial Sequence
  Synthetic Polynucleotide
agctctgaactctcaata

SEQ ID NO: 10424 - DNA, 18 bp, Artificial Sequence
  Synthetic Polynucleotide
acttgtgatggtgagtgg

SEQ ID NO: 10425 - DNA, 17 bp, Artificial Sequence
  Synthetic Polynucleotide
atggtgaatagtgcctg

SEQ ID NO: 10426 - DNA, 18 bp, Artificial Sequence
  Synthetic Polynucleotide
cgtgtgtgtgtgtgtgtg

SEQ ID NO: 10427 - DNA, 18 bp, Artificial Sequence
  Synthetic Polynucleotide
tgcgacgttaagtaaatg

SEQ ID NO: 10428 - DNA, 18 bp, Artificial Sequence
  Synthetic Polynucleotide
catgctacgagaaggagg

SEQ ID NO: 10429 - DNA, 18 bp, Artificial Sequence
  Synthetic Polynucleotide
gcagggtgtgtatattcc

SEQ ID NO: 10430 - DNA, 18 bp, Artificial Sequence
  Synthetic Polynucleotide
tcaatatgtgggtttccg

SEQ ID NO: 10431 - DNA, 17 bp, Artificial Sequence
  Synthetic Polynucleotide
gggtttcagtagatgca

SEQ ID NO: 10432 - DNA, 18 bp, Artificial Sequence
  Synthetic Polynucleotide
gtgggaatagtctgtaca

SEQ ID NO: 10433 - DNA, 17 bp, Artificial Sequence
  Synthetic Polynucleotide
cggcggtgaagacgagc

SEQ ID NO: 10434 - DNA, 17 bp, Artificial Sequence
  Synthetic Polynucleotide
ggtggcgggtgtggcag

SEQ ID NO: 10435 - DNA, 18 bp, Artificial Sequence
  Synthetic Polynucleotide
ttgtgcgaatgaagtgtc

SEQ ID NO: 10436 - DNA, 18 bp, Artificial Sequence
  Synthetic Polynucleotide
acgggtgggtttatatcg

SEQ ID NO: 10437 - DNA, 18 bp, Artificial Sequence
  Synthetic Polynucleotide
gtgaacggatctatggag

SEQ ID NO: 10438 - DNA, 18 bp, Artificial Sequence
  Synthetic Polynucleotide
cggggttgaagaaaagag

SEQ ID NO: 10439 - DNA, 18 bp, Artificial Sequence
  Synthetic Polynucleotide
taacgagggtaatttcta

SEQ ID NO: 10440 - DNA, 17 bp, Artificial Sequence
  Synthetic Polynucleotide
cgacaggtggtgataat

SEQ ID NO: 10441 - DNA, 17 bp, Artificial Sequence
  Synthetic Polynucleotide
gtttgctgtgcgaatgg

SEQ ID NO: 10442 - DNA, 18 bp, Artificial Sequence
  Synthetic Polynucleotide
ctctggatgctgtggagc

SEQ ID NO: 10443 - DNA, 18 bp, Artificial Sequence
  Synthetic Polynucleotide
tttgacgttagtgtttga

SEQ ID NO: 10444 - DNA, 18 bp, Artificial Sequence
  Synthetic Polynucleotide
tcaatcaattacaacggc

SEQ ID NO: 10445 - DNA, 18 bp, Artificial Sequence
  Synthetic Polynucleotide
ctgcgtggaaggtgtata

SEQ ID NO: 10446 - DNA, 17 bp, Artificial Sequence
  Synthetic Polynucleotide
aagctgtgtgaaagagc

SEQ ID NO: 10447 - DNA, 18 bp, Artificial Sequence
  Synthetic Polynucleotide
gatgcggtgactctatcg

SEQ ID NO: 10448 - DNA, 18 bp, Artificial Sequence
  Synthetic Polynucleotide
tccaacagggtgtactga

SEQ ID NO: 10449 - DNA, 17 bp, Artificial Sequence
  Synthetic Polynucleotide
ttgctggaatcctctgc

SEQ ID NO: 10450 - DNA, 18 bp, Artificial Sequence
  Synthetic Polynucleotide
agaataatagggcgatcc

SEQ ID NO: 10451 - DNA, 18 bp, Artificial Sequence
  Synthetic Polynucleotide
acgagatggcgagaacgt

SEQ ID NO: 10452 - DNA, 18 bp, Artificial Sequence
  Synthetic Polynucleotide
tggtttgtgtatggtggc

SEQ ID NO: 10453 - DNA, 17 bp, Artificial Sequence
  Synthetic Polynucleotide
agaagtgtggcgggtgt

SEQ ID NO: 10454 - DNA, 17 bp, Artificial Sequence
  Synthetic Polynucleotide
cgagtgacagtgtgtgg

SEQ ID NO: 10455 - DNA, 18 bp, Artificial Sequence
  Synthetic Polynucleotide
gatgcggacgtttgaaat

SEQ ID NO: 10456 - DNA, 18 bp, Artificial Sequence
  Synthetic Polynucleotide
ccatgtacgaatgatacg

SEQ ID NO: 10457 - DNA, 18 bp, Artificial Sequence
  Synthetic Polynucleotide
acatgaagtgggtgtctg

SEQ ID NO: 10458 - DNA, 17 bp, Artificial Sequence
  Synthetic Polynucleotide
cgatgttcgggtctgtc

SEQ ID NO: 10459 - DNA, 18 bp, Artificial Sequence
  Synthetic Polynucleotide
attgttatgctaggctgg

SEQ ID NO: 10460 - DNA, 18 bp, Artificial Sequence
  Synthetic Polynucleotide
cgtgtgtggcgggtgtga

SEQ ID NO: 10461 - DNA, 17 bp, Artificial Sequence
  Synthetic Polynucleotide
cagcgagtatgttagga

SEQ ID NO: 10462 - DNA, 18 bp, Artificial Sequence
  Synthetic Polynucleotide
agctgactttaagaagga

SEQ ID NO: 10463 - DNA, 17 bp, Artificial Sequence
  Synthetic Polynucleotide
ctgtgaggtgtttgggg

SEQ ID NO: 10464 - DNA, 18 bp, Artificial Sequence
  Synthetic Polynucleotide
cacatgtttgtttgggtt

SEQ ID NO: 10465 - DNA, 18 bp, Artificial Sequence
  Synthetic Polynucleotide
cgagtccatttgaatgtt

SEQ ID NO: 10466 - DNA, 18 bp, Artificial Sequence
  Synthetic Polynucleotide
aaactagaagcggtagaa

SEQ ID NO: 10467 - DNA, 17 bp, Artificial Sequence
  Synthetic Polynucleotide
gcaatatcgggtcttga

SEQ ID NO: 10468 - DNA, 18 bp, Artificial Sequence
  Synthetic Polynucleotide
ttgtccattaagtctgga

SEQ ID NO: 10469 - DNA, 17 bp, Artificial Sequence
  Synthetic Polynucleotide
ctggttgtagaacagga

SEQ ID NO: 10470 - DNA, 17 bp, Artificial Sequence
  Synthetic Polynucleotide
agcgatggcgagctgaa

SEQ ID NO: 10471 - DNA, 17 bp, Artificial Sequence
  Synthetic Polynucleotide
gggcaagtgtatgagtg

SEQ ID NO: 10472 - DNA, 18 bp, Artificial Sequence
  Synthetic Polynucleotide
cgagtgtggcggctatgg

SEQ ID NO: 10473 - DNA, 17 bp, Artificial Sequence
  Synthetic Polynucleotide
tctgatgatcctacggc

SEQ ID NO: 10474 - DNA, 18 bp, Artificial Sequence
  Synthetic Polynucleotide
ctacggagattatgttgc

SEQ ID NO: 10475 - DNA, 18 bp, Artificial Sequence
  Synthetic Polynucleotide
cagtgtggcgggtgtgac

SEQ ID NO: 10476 - DNA, 17 bp, Artificial Sequence
  Synthetic Polynucleotide
cgtggctgtggtatatt

SEQ ID NO: 10477 - DNA, 17 bp, Artificial Sequence
  Synthetic Polynucleotide
atgtagggcgagctaat

SEQ ID NO: 10478 - DNA, 18 bp, Artificial Sequence
  Synthetic Polynucleotide
gtgaaatgtggaagatga

SEQ ID NO: 10479 - DNA, 18 bp, Artificial Sequence
  Synthetic Polynucleotide
tgatgtggcgggtttggc

SEQ ID NO: 10480 - DNA, 17 bp, Artificial Sequence
  Synthetic Polynucleotide
caaaatgtggatgtggc

SEQ ID NO: 10481 - DNA, 18 bp, Artificial Sequence
  Synthetic Polynucleotide
tcatatagaaggtgctga

SEQ ID NO: 10482 - DNA, 17 bp, Artificial Sequence
  Synthetic Polynucleotide
ggagaactctgaaggtg

SEQ ID NO: 10483 - DNA, 17 bp, Artificial Sequence
  Synthetic Polynucleotide
cacgagtgatggaagtg

SEQ ID NO: 10484 - DNA, 17 bp, Artificial Sequence
  Synthetic Polynucleotide
tagataagtgctgggac

SEQ ID NO: 10485 - DNA, 17 bp, Artificial Sequence
  Synthetic Polynucleotide
gaggttgatgtcctggt

SEQ ID NO: 10486 - DNA, 18 bp, Artificial Sequence
  Synthetic Polynucleotide
tatagtagtagtgcgtgc

SEQ ID NO: 10487 - DNA, 17 bp, Artificial Sequence
  Synthetic Polynucleotide
tacctaagtgtgcgagc

SEQ ID NO: 10488 - DNA, 17 bp, Artificial Sequence
  Synthetic Polynucleotide
caaatgtggagcggaat

SEQ ID NO: 10489 - DNA, 17 bp, Artificial Sequence
  Synthetic Polynucleotide
gcagtgaagacgaagta

SEQ ID NO: 10490 - DNA, 18 bp, Artificial Sequence
  Synthetic Polynucleotide
ggttatcggatgtgattc

SEQ ID NO: 10491 - DNA, 17 bp, Artificial Sequence
  Synthetic Polynucleotide
aaatttctggggtggta

SEQ ID NO: 10492 - DNA, 17 bp, Artificial Sequence
  Synthetic Polynucleotide
ttctgtggttgtggatg

SEQ ID NO: 10493 - DNA, 17 bp, Artificial Sequence
  Synthetic Polynucleotide
ggggaggggtgtaaata

SEQ ID NO: 10494 - DNA, 18 bp, Artificial Sequence
  Synthetic Polynucleotide
gtctttagatggtggtcg

SEQ ID NO: 10495 - DNA, 18 bp, Artificial Sequence
  Synthetic Polynucleotide
gttgcaggagaagaattt

SEQ ID NO: 10496 - DNA, 17 bp, Artificial Sequence
  Synthetic Polynucleotide
gagtaaggggtatcacg

SEQ ID NO: 10497 - DNA, 17 bp, Artificial Sequence
  Synthetic Polynucleotide
cagtagaagtagggcag

SEQ ID NO: 10498 - DNA, 18 bp, Artificial Sequence
  Synthetic Polynucleotide
agcggtaagtagtaatgg

SEQ ID NO: 10499 - DNA, 18 bp, Artificial Sequence
  Synthetic Polynucleotide
atgttatgctgtgtgcat

SEQ ID NO: 10500 - DNA, 17 bp, Artificial Sequence
  Synthetic Polynucleotide
acggtatgagaagtgca

SEQ ID NO: 10501 - DNA, 17 bp, Artificial Sequence
  Synthetic Polynucleotide
aagcgaagcgaatgaga

SEQ ID NO: 10502 - DNA, 18 bp, Artificial Sequence
  Synthetic Polynucleotide
aattgtgtttgtgttcgt

SEQ ID NO: 10503 - DNA, 18 bp, Artificial Sequence
  Synthetic Polynucleotide
tgtaagcgtggtgacaac

SEQ ID NO: 10504 - DNA, 18 bp, Artificial Sequence
  Synthetic Polynucleotide
ccgggcggaagatgacta

SEQ ID NO: 10505 - DNA, 18 bp, Artificial Sequence
  Synthetic Polynucleotide
ctgtgtccattgaacaaa

SEQ ID NO: 10506 - DNA, 18 bp, Artificial Sequence
  Synthetic Polynucleotide
tgcaataattttggcaga

SEQ ID NO: 10507 - DNA, 17 bp, Artificial Sequence
  Synthetic Polynucleotide
gcgagtctgtgggtgta

SEQ ID NO: 10508 - DNA, 18 bp, Artificial Sequence
  Synthetic Polynucleotide
tctggatctatgtatgga

SEQ ID NO: 10509 - DNA, 17 bp, Artificial Sequence
  Synthetic Polynucleotide
aagtggtgatgtgggca

SEQ ID NO: 10510 - DNA, 17 bp, Artificial Sequence
  Synthetic Polynucleotide
cgttagggctatgtggc

SEQ ID NO: 10511 - DNA, 18 bp, Artificial Sequence
  Synthetic Polynucleotide
ccttttggtttatgggta

SEQ ID NO: 10512 - DNA, 17 bp, Artificial Sequence
  Synthetic Polynucleotide
cccttgtggtgacaacg

SEQ ID NO: 10513 - DNA, 18 bp, Artificial Sequence
  Synthetic Polynucleotide
caatgcggagtgtcggaa

SEQ ID NO: 10514 - DNA, 18 bp, Artificial Sequence
  Synthetic Polynucleotide
atgggaataagaacagga

SEQ ID NO: 10515 - DNA, 17 bp, Artificial Sequence
  Synthetic Polynucleotide
aagtggtgtggaggcta

SEQ ID NO: 10516 - DNA, 18 bp, Artificial Sequence
  Synthetic Polynucleotide
aaggcttttgtggttttg

SEQ ID NO: 10517 - DNA, 18 bp, Artificial Sequence
  Synthetic Polynucleotide
ggtcgttttgaaagaacg

SEQ ID NO: 10518 - DNA, 18 bp, Artificial Sequence
  Synthetic Polynucleotide
tggaaaagtggggttagg

SEQ ID NO: 10519 - DNA, 18 bp, Artificial Sequence
  Synthetic Polynucleotide
caggtgaatgggtggtaa

SEQ ID NO: 10520 - DNA, 17 bp, Artificial Sequence
  Synthetic Polynucleotide
aacagggtgtgatttcc

SEQ ID NO: 10521 - DNA, 17 bp, Artificial Sequence
  Synthetic Polynucleotide
ctatgggtggtgtggta

SEQ ID NO: 10522 - DNA, 18 bp, Artificial Sequence
  Synthetic Polynucleotide
catggttaagtacggtgc

SEQ ID NO: 10523 - DNA, 17 bp, Artificial Sequence
  Synthetic Polynucleotide
gtgtgggacgaagttta

SEQ ID NO: 10524 - DNA, 18 bp, Artificial Sequence
  Synthetic Polynucleotide
ctcttattgtgcgtgcag

SEQ ID NO: 10525 - DNA, 17 bp, Artificial Sequence
  Synthetic Polynucleotide
gtcagtgagaagtgcaa

SEQ ID NO: 10526 - DNA, 18 bp, Artificial Sequence
  Synthetic Polynucleotide
ctggtgtgtgcaagtggt

SEQ ID NO: 10527 - DNA, 18 bp, Artificial Sequence
  Synthetic Polynucleotide
gcttggaagaagacgaag

SEQ ID NO: 10528 - DNA, 18 bp, Artificial Sequence
  Synthetic Polynucleotide
atggtgcaaagaatttga

SEQ ID NO: 10529 - DNA, 17 bp, Artificial Sequence
  Synthetic Polynucleotide
cggctaagatgtggaac

SEQ ID NO: 10530 - DNA, 18 bp, Artificial Sequence
  Synthetic Polynucleotide
cttggcgaagattttcac

SEQ ID NO: 10531 - DNA, 18 bp, Artificial Sequence
  Synthetic Polynucleotide
catcggtaagtagacgga

SEQ ID NO: 10532 - DNA, 17 bp, Artificial Sequence
  Synthetic Polynucleotide
cgaaggtttctgggtat

SEQ ID NO: 10533 - DNA, 17 bp, Artificial Sequence
  Synthetic Polynucleotide
catgtgtgggacgtatg

SEQ ID NO: 10534 - DNA, 18 bp, Artificial Sequence
  Synthetic Polynucleotide
cagtggttttatggcttt

SEQ ID NO: 10535 - DNA, 17 bp, Artificial Sequence
  Synthetic Polynucleotide
gttggcgggtttggcat

SEQ ID NO: 10536 - DNA, 17 bp, Artificial Sequence
  Synthetic Polynucleotide
taagttgtgtggtggca

SEQ ID NO: 10537 - DNA, 17 bp, Artificial Sequence
  Synthetic Polynucleotide
agtagcgggaagagatg

SEQ ID NO: 10538 - DNA, 18 bp, Artificial Sequence
  Synthetic Polynucleotide
cctaataaatgcgggaac

SEQ ID NO: 10539 - DNA, 18 bp, Artificial Sequence
  Synthetic Polynucleotide
ccgggagtattttgtggg

SEQ ID NO: 10540 - DNA, 17 bp, Artificial Sequence
  Synthetic Polynucleotide
ggacggggttaatagtg

SEQ ID NO: 10541 - DNA, 18 bp, Artificial Sequence
  Synthetic Polynucleotide
gatgttgctaagtgacta

SEQ ID NO: 10542 - DNA, 18 bp, Artificial Sequence
  Synthetic Polynucleotide
ttagtgacgaatgctgaa

SEQ ID NO: 10543 - DNA, 17 bp, Artificial Sequence
  Synthetic Polynucleotide
cacggaggtaatgtttg

SEQ ID NO: 10544 - DNA, 17 bp, Artificial Sequence
  Synthetic Polynucleotide
atcagaagtgtgtgctt

SEQ ID NO: 10545 - DNA, 18 bp, Artificial Sequence
  Synthetic Polynucleotide
cgtggctgtgatatatta

SEQ ID NO: 10546 - DNA, 18 bp, Artificial Sequence
  Synthetic Polynucleotide
agtgtgatatgtatgggg

SEQ ID NO: 10547 - DNA, 17 bp, Artificial Sequence
  Synthetic Polynucleotide
tttgacgagcggggctg

SEQ ID NO: 10548 - DNA, 18 bp, Artificial Sequence
  Synthetic Polynucleotide
gatgagttagacgtgact

SEQ ID NO: 10549 - DNA, 17 bp, Artificial Sequence
  Synthetic Polynucleotide
cgagaaggggaacaatt

SEQ ID NO: 10550 - DNA, 18 bp, Artificial Sequence
  Synthetic Polynucleotide
agatggtgtatccatgta

SEQ ID NO: 10551 - DNA, 17 bp, Artificial Sequence
  Synthetic Polynucleotide
ttgggtacgagtgtgct

SEQ ID NO: 10552 - DNA, 18 bp, Artificial Sequence
  Synthetic Polynucleotide
caaagtgcgttttgtgaa

SEQ ID NO: 10553 - DNA, 18 bp, Artificial Sequence
  Synthetic Polynucleotide
tcgaggtgtgttaggctc

SEQ ID NO: 10554 - DNA, 18 bp, Artificial Sequence
  Synthetic Polynucleotide
taagtggggcagggtgac

SEQ ID NO: 10555 - DNA, 17 bp, Artificial Sequence
  Synthetic Polynucleotide
atcgaagaagggtgttc

SEQ ID NO: 10556 - DNA, 18 bp, Artificial Sequence
  Synthetic Polynucleotide
aggtggaggtgaagtgtc

SEQ ID NO: 10557 - DNA, 17 bp, Artificial Sequence
  Synthetic Polynucleotide
tagtgcgtggtttaaat

SEQ ID NO: 10558 - DNA, 18 bp, Artificial Sequence
  Synthetic Polynucleotide
atatttcgggctaagtcg

SEQ ID NO: 10559 - DNA, 17 bp, Artificial Sequence
  Synthetic Polynucleotide
tcaatgttgatgtgcat

SEQ ID NO: 10560 - DNA, 18 bp, Artificial Sequence
  Synthetic Polynucleotide
agtagaagaagtttcgga

SEQ ID NO: 10561 - DNA, 18 bp, Artificial Sequence
  Synthetic Polynucleotide
ccaacgaagtatttccta

SEQ ID NO: 10562 - DNA, 18 bp, Artificial Sequence
  Synthetic Polynucleotide
ggttaagttatgaagcgg

SEQ ID NO: 10563 - DNA, 17 bp, Artificial Sequence
  Synthetic Polynucleotide
ttttgtgctggggctgg

SEQ ID NO: 10564 - DNA, 17 bp, Artificial Sequence
  Synthetic Polynucleotide
tcgggtgttagaagttt

SEQ ID NO: 10565 - DNA, 18 bp, Artificial Sequence
  Synthetic Polynucleotide
cgcggtgaatgtttatgt

SEQ ID NO: 10566 - DNA, 17 bp, Artificial Sequence
  Synthetic Polynucleotide
tctaagggtgatggtgt

SEQ ID NO: 10567 - DNA, 18 bp, Artificial Sequence
  Synthetic Polynucleotide
ttgtgtggctgatgtggc

SEQ ID NO: 10568 - DNA, 18 bp, Artificial Sequence
  Synthetic Polynucleotide
gggtatggcgagttaacg

SEQ ID NO: 10569 - DNA, 18 bp, Artificial Sequence
  Synthetic Polynucleotide
taaaatgtgaacgggatt

SEQ ID NO: 10570 - DNA, 18 bp, Artificial Sequence
  Synthetic Polynucleotide
cggctgttagggctttta

SEQ ID NO: 10571 - DNA, 18 bp, Artificial Sequence
  Synthetic Polynucleotide
gcaagtaatgcaagtgaa

SEQ ID NO: 10572 - DNA, 17 bp, Artificial Sequence
  Synthetic Polynucleotide
aagctgatggtggcaag

SEQ ID NO: 10573 - DNA, 17 bp, Artificial Sequence
  Synthetic Polynucleotide
caagtgtggcgagcgtg

SEQ ID NO: 10574 - DNA, 18 bp, Artificial Sequence
  Synthetic Polynucleotide
cgtgtggcgggtttggca

SEQ ID NO: 10575 - DNA, 18 bp, Artificial Sequence
  Synthetic Polynucleotide
tcggagtgtgaataatgg

SEQ ID NO: 10576 - DNA, 17 bp, Artificial Sequence
  Synthetic Polynucleotide
cctaggtgctagaatgc

SEQ ID NO: 10577 - DNA, 17 bp, Artificial Sequence
  Synthetic Polynucleotide
gtttgtgtaagcggaag

SEQ ID NO: 10578 - DNA, 18 bp, Artificial Sequence
  Synthetic Polynucleotide
acgtgtggcgagtatggc

SEQ ID NO: 10579 - DNA, 17 bp, Artificial Sequence
  Synthetic Polynucleotide
ccatgatgaaagtgtgc

SEQ ID NO: 10580 - DNA, 18 bp, Artificial Sequence
  Synthetic Polynucleotide
catggtgatgaagtcgag

SEQ ID NO: 10581 - DNA, 18 bp, Artificial Sequence
  Synthetic Polynucleotide
gaaattgtatcggatgcc

SEQ ID NO: 10582 - DNA, 18 bp, Artificial Sequence
  Synthetic Polynucleotide
ggagaacgagaatacagg

SEQ ID NO: 10583 - DNA, 18 bp, Artificial Sequence
  Synthetic Polynucleotide
agtgcgggtatgagaatt

SEQ ID NO: 10584 - DNA, 17 bp, Artificial Sequence
  Synthetic Polynucleotide
cgacgtaagtagtggta

SEQ ID NO: 10585 - DNA, 18 bp, Artificial Sequence
  Synthetic Polynucleotide
tcttggtacgggagtata

SEQ ID NO: 10586 - DNA, 17 bp, Artificial Sequence
  Synthetic Polynucleotide
ccatgaagcgagtcttt

SEQ ID NO: 10587 - DNA, 18 bp, Artificial Sequence
  Synthetic Polynucleotide
tatttgtgttgctatgct

SEQ ID NO: 10588 - DNA, 18 bp, Artificial Sequence
  Synthetic Polynucleotide
catgtgtgggctattatc

SEQ ID NO: 10589 - DNA, 17 bp, Artificial Sequence
  Synthetic Polynucleotide
gtggcaggtgtggcggc

SEQ ID NO: 10590 - DNA, 18 bp, Artificial Sequence
  Synthetic Polynucleotide
gtatggcgagtatggtcg

SEQ ID NO: 10591 - DNA, 18 bp, Artificial Sequence
  Synthetic Polynucleotide
aagagtgtaagtggtgcg

SEQ ID NO: 10592 - DNA, 17 bp, Artificial Sequence
  Synthetic Polynucleotide
tcatgatgtgctctctc

SEQ ID NO: 10593 - DNA, 17 bp, Artificial Sequence
  Synthetic Polynucleotide
aatggtgtgaatcgggc

SEQ ID NO: 10594 - DNA, 18 bp, Artificial Sequence
  Synthetic Polynucleotide
gtcggaatgaatgacaat

SEQ ID NO: 10595 - DNA, 18 bp, Artificial Sequence
  Synthetic Polynucleotide
cgaatgatagtagtggcg

SEQ ID NO: 10596 - DNA, 17 bp, Artificial Sequence
  Synthetic Polynucleotide
gttggcgggtttggtag

SEQ ID NO: 10597 - DNA, 18 bp, Artificial Sequence
  Synthetic Polynucleotide
gcggaatggtgtaagatt

SEQ ID NO: 10598 - DNA, 18 bp, Artificial Sequence
  Synthetic Polynucleotide
cgtgagctaagtgaattt

SEQ ID NO: 10599 - DNA, 18 bp, Artificial Sequence
  Synthetic Polynucleotide
taagcgagtgtgttattg

SEQ ID NO: 10600 - DNA, 17 bp, Artificial Sequence
  Synthetic Polynucleotide
taagtgtggcggatatg

SEQ ID NO: 10601 - DNA, 17 bp, Artificial Sequence
  Synthetic Polynucleotide
gggatgttgctgtgtcg

SEQ ID NO: 10602 - DNA, 17 bp, Artificial Sequence
  Synthetic Polynucleotide
cgaatgatgtggctgtc

SEQ ID NO: 10603 - DNA, 18 bp, Artificial Sequence
  Synthetic Polynucleotide
tacggagaacggtgattg

SEQ ID NO: 10604 - DNA, 18 bp, Artificial Sequence
  Synthetic Polynucleotide
catgaactaaatgacgga

SEQ ID NO: 10605 - DNA, 17 bp, Artificial Sequence
  Synthetic Polynucleotide
atgggtttgatgagtgg

SEQ ID NO: 10606 - DNA, 18 bp, Artificial Sequence
  Synthetic Polynucleotide
aatgtgtggcgagaactt

SEQ ID NO: 10607 - DNA, 18 bp, Artificial Sequence
  Synthetic Polynucleotide
aaagcgaggtgattagta

SEQ ID NO: 10608 - DNA, 17 bp, Artificial Sequence
  Synthetic Polynucleotide
cctaaagcgaggtgaaa

SEQ ID NO: 10609 - DNA, 18 bp, Artificial Sequence
  Synthetic Polynucleotide
gcgaattatgtagacggc

SEQ ID NO: 10610 - DNA, 18 bp, Artificial Sequence
  Synthetic Polynucleotide
tatttgggtggttgttat

SEQ ID NO: 10611 - DNA, 17 bp, Artificial Sequence
  Synthetic Polynucleotide
cggcgagtgttaaatgt

SEQ ID NO: 10612 - DNA, 17 bp, Artificial Sequence
  Synthetic Polynucleotide
ttcttttgaagggtgga

SEQ ID NO: 10613 - DNA, 18 bp, Artificial Sequence
  Synthetic Polynucleotide
gtcaggggcaaagattat

SEQ ID NO: 10614 - DNA, 18 bp, Artificial Sequence
  Synthetic Polynucleotide
tgatgtggggcaagtgtg

SEQ ID NO: 10615 - DNA, 17 bp, Artificial Sequence
  Synthetic Polynucleotide
gatattttgggcgaggc

SEQ ID NO: 10616 - DNA, 17 bp, Artificial Sequence
  Synthetic Polynucleotide
ggatgggtttcctagag

SEQ ID NO: 10617 - DNA, 18 bp, Artificial Sequence
  Synthetic Polynucleotide
ggctgtggtcttttatta

SEQ ID NO: 10618 - DNA, 18 bp, Artificial Sequence
  Synthetic Polynucleotide
tgatgtggcggatgtggc

SEQ ID NO: 10619 - DNA, 18 bp, Artificial Sequence
  Synthetic Polynucleotide
gttttagcgtatagggca

SEQ ID NO: 10620 - DNA, 18 bp, Artificial Sequence
  Synthetic Polynucleotide
ccgagtgatagtagggct

SEQ ID NO: 10621 - DNA, 17 bp, Artificial Sequence
  Synthetic Polynucleotide
aatgtccttgtggagag

SEQ ID NO: 10622 - DNA, 17 bp, Artificial Sequence
  Synthetic Polynucleotide
catatgtggcaggagtg

SEQ ID NO: 10623 - DNA, 17 bp, Artificial Sequence
  Synthetic Polynucleotide
aactagatgtgacgggg

SEQ ID NO: 10624 - DNA, 17 bp, Artificial Sequence
  Synthetic Polynucleotide
gagctggaaggtgtcgt

SEQ ID NO: 10625 - DNA, 18 bp, Artificial Sequence
  Synthetic Polynucleotide
cgtggcgttaagataagg

SEQ ID NO: 10626 - DNA, 17 bp, Artificial Sequence
  Synthetic Polynucleotide
tgcttgtgaagaacggt

SEQ ID NO: 10627 - DNA, 17 bp, Artificial Sequence
  Synthetic Polynucleotide
catgaaggtggcggggc

SEQ ID NO: 10628 - DNA, 17 bp, Artificial Sequence
  Synthetic Polynucleotide
cgttaagtaatgcggta

SEQ ID NO: 10629 - DNA, 17 bp, Artificial Sequence
  Synthetic Polynucleotide
tcgggagaaataagtgc

SEQ ID NO: 10630 - DNA, 18 bp, Artificial Sequence
  Synthetic Polynucleotide
ggtgtatggctaaattga

SEQ ID NO: 10631 - DNA, 18 bp, Artificial Sequence
  Synthetic Polynucleotide
gcttgtgcgtgtttgaaa

SEQ ID NO: 10632 - DNA, 18 bp, Artificial Sequence
  Synthetic Polynucleotide
gctcttgtgagaatttcc

SEQ ID NO: 10633 - DNA, 17 bp, Artificial Sequence
  Synthetic Polynucleotide
gctctgatgatacggag

SEQ ID NO: 10634 - DNA, 17 bp, Artificial Sequence
  Synthetic Polynucleotide
tccttgtatggtgcggc

SEQ ID NO: 10635 - DNA, 17 bp, Artificial Sequence
  Synthetic Polynucleotide
tgtttgtgagacggtaa

SEQ ID NO: 10636 - DNA, 18 bp, Artificial Sequence
  Synthetic Polynucleotide
tctagtcgggaagatttt

SEQ ID NO: 10637 - DNA, 18 bp, Artificial Sequence
  Synthetic Polynucleotide
gtaaatgtggcgagcgtg

SEQ ID NO: 10638 - DNA, 18 bp, Artificial Sequence
  Synthetic Polynucleotide
tcgaaggttagatttcca

SEQ ID NO: 10639 - DNA, 18 bp, Artificial Sequence
  Synthetic Polynucleotide
attgggttacgggaataa

SEQ ID NO: 10640 - DNA, 17 bp, Artificial Sequence
  Synthetic Polynucleotide
acgaataagtgcgagtt

SEQ ID NO: 10641 - DNA, 17 bp, Artificial Sequence
  Synthetic Polynucleotide
tgggtcgtgagtgagac

SEQ ID NO: 10642 - DNA, 17 bp, Artificial Sequence
  Synthetic Polynucleotide
gcaaatcggtgtttcaa

SEQ ID NO: 10643 - DNA, 17 bp, Artificial Sequence
  Synthetic Polynucleotide
tctacagtagcaaggga

SEQ ID NO: 10644 - DNA, 17 bp, Artificial Sequence
  Synthetic Polynucleotide
tgctgccacaggatttt

SEQ ID NO: 10645 - DNA, 17 bp, Artificial Sequence
  Synthetic Polynucleotide
ggagctgcccctggaca

SEQ ID NO: 10646 - DNA, 18 bp, Artificial Sequence
  Synthetic Polynucleotide
ttgcctttacttctaggc

SEQ ID NO: 10647 - DNA, 17 bp, Artificial Sequence
  Synthetic Polynucleotide
cagaccacaaactggtc

SEQ ID NO: 10648 - DNA, 18 bp, Artificial Sequence
  Synthetic Polynucleotide
aacagaaaatgtgccaaa

SEQ ID NO: 10649 - DNA, 18 bp, Artificial Sequence
  Synthetic Polynucleotide
tattgtttccccaagaag

SEQ ID NO: 10650 - DNA, 17 bp, Artificial Sequence
  Synthetic Polynucleotide
cacaggtaagactgggg

SEQ ID NO: 10651 - DNA, 17 bp, Artificial Sequence
  Synthetic Polynucleotide
gaataccctcatggagg

SEQ ID NO: 10652 - DNA, 17 bp, Artificial Sequence
  Synthetic Polynucleotide
ccgctctcttcaggttc

SEQ ID NO: 10653 - DNA, 17 bp, Artificial Sequence
  Synthetic Polynucleotide
gctgctaaggttgtttt

SEQ ID NO: 10654 - DNA, 18 bp, Artificial Sequence
  Synthetic Polynucleotide
tccttttggaactccttg

SEQ ID NO: 10655 - DNA, 17 bp, Artificial Sequence
  Synthetic Polynucleotide
accaccacacacacagg

SEQ ID NO: 10656 - DNA, 17 bp, Artificial Sequence
  Synthetic Polynucleotide
ggccgttacatagcctt

SEQ ID NO: 10657 - DNA, 18 bp, Artificial Sequence
  Synthetic Polynucleotide
acaaagaggcccaactcc

SEQ ID NO: 10658 - DNA, 18 bp, Artificial Sequence
  Synthetic Polynucleotide
gggaggaaagtacatcta

SEQ ID NO: 10659 - DNA, 17 bp, Artificial Sequence
  Synthetic Polynucleotide
tcctctgagacccctat

SEQ ID NO: 10660 - DNA, 17 bp, Artificial Sequence
  Synthetic Polynucleotide
cggttcgtttccatttg

SEQ ID NO: 10661 - DNA, 17 bp, Artificial Sequence
  Synthetic Polynucleotide
caacagatgctagttgc

SEQ ID NO: 10662 - DNA, 18 bp, Artificial Sequence
  Synthetic Polynucleotide
gggacacggttgagtaac

SEQ ID NO: 10663 - DNA, 18 bp, Artificial Sequence
  Synthetic Polynucleotide
tgctaactctctggactg

SEQ ID NO: 10664 - DNA, 18 bp, Artificial Sequence
  Synthetic Polynucleotide
attgatccttttcgctgg

SEQ ID NO: 10665 - DNA, 17 bp, Artificial Sequence
  Synthetic Polynucleotide
tcacaatgctcttccca

SEQ ID NO: 10666 - DNA, 18 bp, Artificial Sequence
  Synthetic Polynucleotide
caaacactgccacaacag

SEQ ID NO: 10667 - DNA, 18 bp, Artificial Sequence
  Synthetic Polynucleotide
tgtgcaatagaccaaatg

SEQ ID NO: 10668 - DNA, 18 bp, Artificial Sequence
  Synthetic Polynucleotide
caacacacgttgcacttt

SEQ ID NO: 10669 - DNA, 17 bp, Artificial Sequence
  Synthetic Polynucleotide
ggatctgccatttcagt

SEQ ID NO: 10670 - DNA, 17 bp, Artificial Sequence
  Synthetic Polynucleotide
gctgtctggactgattc

SEQ ID NO: 10671 - DNA, 17 bp, Artificial Sequence
  Synthetic Polynucleotide
acgtttccatccaagcc

SEQ ID NO: 10672 - DNA, 17 bp, Artificial Sequence
  Synthetic Polynucleotide
ggaatgtgggtgatgat

SEQ ID NO: 10673 - DNA, 17 bp, Artificial Sequence
  Synthetic Polynucleotide
aaaccatatcgtggcat

SEQ ID NO: 10674 - DNA, 17 bp, Artificial Sequence
  Synthetic Polynucleotide
atggtttggtgcattga

SEQ ID NO: 10675 - DNA, 17 bp, Artificial Sequence
  Synthetic Polynucleotide
ttccactgtgtgtctct

SEQ ID NO: 10676 - DNA, 17 bp, Artificial Sequence
  Synthetic Polynucleotide
atatctggtgtctgggt

SEQ ID NO: 10677 - DNA, 17 bp, Artificial Sequence
  Synthetic Polynucleotide
aagcattgcgaggaaaa

SEQ ID NO: 10678 - DNA, 17 bp, Artificial Sequence
  Synthetic Polynucleotide
ggagcttctggtgatcc

SEQ ID NO: 10679 - DNA, 18 bp, Artificial Sequence
  Synthetic Polynucleotide
ttgctgtgtgcctttctg

SEQ ID NO: 10680 - DNA, 17 bp, Artificial Sequence
  Synthetic Polynucleotide
gcgctgaagaattcgaa

SEQ ID NO: 10681 - DNA, 18 bp, Artificial Sequence
  Synthetic Polynucleotide
aattggtgctgctgtgaa

SEQ ID NO: 10682 - DNA, 17 bp, Artificial Sequence
  Synthetic Polynucleotide
tatgtgactgatcctga

SEQ ID NO: 10683 - DNA, 17 bp, Artificial Sequence
  Synthetic Polynucleotide
gatccatctggtgttgc

SEQ ID NO: 10684 - DNA, 17 bp, Artificial Sequence
  Synthetic Polynucleotide
atgagatcctgtgagcg

SEQ ID NO: 10685 - DNA, 17 bp, Artificial Sequence
  Synthetic Polynucleotide
agaagtgtgtgcatgtt

SEQ ID NO: 10686 - DNA, 17 bp, Artificial Sequence
  Synthetic Polynucleotide
gcaagttgtttggactt

SEQ ID NO: 10687 - DNA, 18 bp, Artificial Sequence
  Synthetic Polynucleotide
ttctccaacctttcttcc

SEQ ID NO: 10688 - DNA, 17 bp, Artificial Sequence
  Synthetic Polynucleotide
gtgcgtacaacgagttc

SEQ ID NO: 10689 - DNA, 17 bp, Artificial Sequence
  Synthetic Polynucleotide
tggctgtccactgttat

SEQ ID NO: 10690 - DNA, 18 bp, Artificial Sequence
  Synthetic Polynucleotide
tccataccttttgaatgc

SEQ ID NO: 10691 - DNA, 17 bp, Artificial Sequence
  Synthetic Polynucleotide
gaccatgagtgtgttgt

SEQ ID NO: 10692 - DNA, 17 bp, Artificial Sequence
  Synthetic Polynucleotide
gggtgggtgtattgtga

SEQ ID NO: 10693 - DNA, 17 bp, Artificial Sequence
  Synthetic Polynucleotide
ggctgtgtgcctctctg

SEQ ID NO: 10694 - DNA, 18 bp, Artificial Sequence
  Synthetic Polynucleotide
agcgtatattgaaatgcg

SEQ ID NO: 10695 - DNA, 17 bp, Artificial Sequence
  Synthetic Polynucleotide
ggttgcatcttgtcaaa

SEQ ID NO: 10696 - DNA, 17 bp, Artificial Sequence
  Synthetic Polynucleotide
atactttgtggtgcgag

SEQ ID NO: 10697 - DNA, 18 bp, Artificial Sequence
  Synthetic Polynucleotide
accaagtttcattgttcg

SEQ ID NO: 10698 - DNA, 17 bp, Artificial Sequence
  Synthetic Polynucleotide
atacctgggcgtgaatc

SEQ ID NO: 10699 - DNA, 17 bp, Artificial Sequence
  Synthetic Polynucleotide
gctgccttcatttgtgc

SEQ ID NO: 10700 - DNA, 18 bp, Artificial Sequence
  Synthetic Polynucleotide
tggtttggtgtatagaga

SEQ ID NO: 10701 - DNA, 18 bp, Artificial Sequence
  Synthetic Polynucleotide
cctcttcttgtgttccaa

SEQ ID NO: 10702 - DNA, 17 bp, Artificial Sequence
  Synthetic Polynucleotide
tggtgcattgagaatgg

SEQ ID NO: 10703 - DNA, 17 bp, Artificial Sequence
  Synthetic Polynucleotide
gccttcatctgcatgtg

SEQ ID NO: 10704 - DNA, 18 bp, Artificial Sequence
  Synthetic Polynucleotide
aaatgtgggtttggcgtg

SEQ ID NO: 10705 - DNA, 17 bp, Artificial Sequence
  Synthetic Polynucleotide
tctggtgcattgagaac

SEQ ID NO: 10706 - DNA, 17 bp, Artificial Sequence
  Synthetic Polynucleotide
gctgctgctttcatctg

SEQ ID NO: 10707 - DNA, 18 bp, Artificial Sequence
  Synthetic Polynucleotide
acttgaccgactatagct

SEQ ID NO: 10708 - DNA, 18 bp, Artificial Sequence
  Synthetic Polynucleotide
tgcctttctgtgtcctgc

SEQ ID NO: 10709 - DNA, 18 bp, Artificial Sequence
  Synthetic Polynucleotide
atgtcccatactggaaag

SEQ ID NO: 10710 - DNA, 17 bp, Artificial Sequence
  Synthetic Polynucleotide
ctccgaatccaagtcat

SEQ ID NO: 10711 - DNA, 18 bp, Artificial Sequence
  Synthetic Polynucleotide
tgctgaatgtgaatgaga

SEQ ID NO: 10712 - DNA, 17 bp, Artificial Sequence
  Synthetic Polynucleotide
gccttcctaagacgtgc

SEQ ID NO: 10713 - DNA, 18 bp, Artificial Sequence
  Synthetic Polynucleotide
tcaaactctcttctttgc

SEQ ID NO: 10714 - DNA, 17 bp, Artificial Sequence
  Synthetic Polynucleotide
gatgcgtagctgagata

SEQ ID NO: 10715 - DNA, 18 bp, Artificial Sequence
  Synthetic Polynucleotide
ttcaatttggcgtgtgta

SEQ ID NO: 10716 - DNA, 17 bp, Artificial Sequence
  Synthetic Polynucleotide
aaccttttgtccactgc

SEQ ID NO: 10717 - DNA, 17 bp, Artificial Sequence
  Synthetic Polynucleotide
ggtttgcgtgattacaa

SEQ ID NO: 10718 - DNA, 17 bp, Artificial Sequence
  Synthetic Polynucleotide
tgctgccttcatctgga

SEQ ID NO: 10719 - DNA, 17 bp, Artificial Sequence
  Synthetic Polynucleotide
ggtttggtgcatcgaga

SEQ ID NO: 10720 - DNA, 17 bp, Artificial Sequence
  Synthetic Polynucleotide
ctgctgctttcatctga

SEQ ID NO: 10721 - DNA, 18 bp, Artificial Sequence
  Synthetic Polynucleotide
aggctgttgttaaagagg

SEQ ID NO: 10722 - DNA, 18 bp, Artificial Sequence
  Synthetic Polynucleotide
atgtttgttgcgactatg

SEQ ID NO: 10723 - DNA, 18 bp, Artificial Sequence
  Synthetic Polynucleotide
ctggtttatgttgcaagc

SEQ ID NO: 10724 - DNA, 17 bp, Artificial Sequence
  Synthetic Polynucleotide
gtctctctgtgtcctct

SEQ ID NO: 10725 - DNA, 18 bp, Artificial Sequence
  Synthetic Polynucleotide
agcgtgattatgaggtca

SEQ ID NO: 10726 - DNA, 17 bp, Artificial Sequence
  Synthetic Polynucleotide
atcccaatcttccatga

SEQ ID NO: 10727 - DNA, 18 bp, Artificial Sequence
  Synthetic Polynucleotide
aagtctgtgttgatgact

SEQ ID NO: 10728 - DNA, 17 bp, Artificial Sequence
  Synthetic Polynucleotide
tctggtgttgctattgg

SEQ ID NO: 10729 - DNA, 17 bp, Artificial Sequence
  Synthetic Polynucleotide
gttggctgtattgtgac

SEQ ID NO: 10730 - DNA, 17 bp, Artificial Sequence
  Synthetic Polynucleotide
ccatctggtgttgctat

SEQ ID NO: 10731 - DNA, 18 bp, Artificial Sequence
  Synthetic Polynucleotide
agcgtgagtattttgcag

SEQ ID NO: 10732 - DNA, 17 bp, Artificial Sequence
  Synthetic Polynucleotide
gctcttgtgaactccat

SEQ ID NO: 10733 - DNA, 18 bp, Artificial Sequence
  Synthetic Polynucleotide
ggaggagtgtaaattcga

SEQ ID NO: 10734 - DNA, 17 bp, Artificial Sequence
  Synthetic Polynucleotide
tggtgctgctgtaaaag

SEQ ID NO: 10735 - DNA, 18 bp, Artificial Sequence
  Synthetic Polynucleotide
acagtttcaagggtttct

SEQ ID NO: 10736 - DNA, 18 bp, Artificial Sequence
  Synthetic Polynucleotide
cctggtggtgttgctgag

SEQ ID NO: 10737 - DNA, 18 bp, Artificial Sequence
  Synthetic Polynucleotide
tggttttgcctttcacta

SEQ ID NO: 10738 - DNA, 18 bp, Artificial Sequence
  Synthetic Polynucleotide
ggtgcatagatccatcat

SEQ ID NO: 10739 - DNA, 17 bp, Artificial Sequence
  Synthetic Polynucleotide
ggctagttacaacgagg

SEQ ID NO: 10740 - DNA, 17 bp, Artificial Sequence
  Synthetic Polynucleotide
gcttcaatcattgctgc

SEQ ID NO: 10741 - DNA, 18 bp, Artificial Sequence
  Synthetic Polynucleotide
tcaactctgttcttagca

SEQ ID NO: 10742 - DNA, 17 bp, Artificial Sequence
  Synthetic Polynucleotide
accatgagtgtgttgtc

SEQ ID NO: 10743 - DNA, 17 bp, Artificial Sequence
  Synthetic Polynucleotide
aacttagaccgttcgag

SEQ ID NO: 10744 - DNA, 17 bp, Artificial Sequence
  Synthetic Polynucleotide
agttctgggtgtccatc

SEQ ID NO: 10745 - DNA, 17 bp, Artificial Sequence
  Synthetic Polynucleotide
ttgacttctttgtcccc

SEQ ID NO: 10746 - DNA, 18 bp, Artificial Sequence
  Synthetic Polynucleotide
ctctgggcattgtagttt

SEQ ID NO: 10747 - DNA, 18 bp, Artificial Sequence
  Synthetic Polynucleotide
ttgtggctaccttagact

SEQ ID NO: 10748 - DNA, 18 bp, Artificial Sequence
  Synthetic Polynucleotide
tctctgactgaaatccag

SEQ ID NO: 10749 - DNA, 17 bp, Artificial Sequence
  Synthetic Polynucleotide
gggttcctagtgacgaa

SEQ ID NO: 10750 - DNA, 18 bp, Artificial Sequence
  Synthetic Polynucleotide
tagagcttcttttccgaa

SEQ ID NO: 10751 - DNA, 18 bp, Artificial Sequence
  Synthetic Polynucleotide
ttctggtgagaccatttt

SEQ ID NO: 10752 - DNA, 18 bp, Artificial Sequence
  Synthetic Polynucleotide
tcgtaaatgtgtattgca

SEQ ID NO: 10753 - DNA, 17 bp, Artificial Sequence
  Synthetic Polynucleotide
tgcctatccatctggct

SEQ ID NO: 10754 - DNA, 18 bp, Artificial Sequence
  Synthetic Polynucleotide
atttgtgtcaattgtccc

SEQ ID NO: 10755 - DNA, 18 bp, Artificial Sequence
  Synthetic Polynucleotide
tccataaccttaagtgcg

SEQ ID NO: 10756 - DNA, 18 bp, Artificial Sequence
  Synthetic Polynucleotide
ttgtttcgatccattagc

SEQ ID NO: 10757 - DNA, 18 bp, Artificial Sequence
  Synthetic Polynucleotide
aatctttcatcctgacgc

SEQ ID NO: 10758 - DNA, 17 bp, Artificial Sequence
  Synthetic Polynucleotide
tgatgatgtcgttcccg

SEQ ID NO: 10759 - DNA, 17 bp, Artificial Sequence
  Synthetic Polynucleotide
tgctttcttccgatctg

SEQ ID NO: 10760 - DNA, 18 bp, Artificial Sequence
  Synthetic Polynucleotide
ctccatgtttagagtgca

SEQ ID NO: 10761 - DNA, 18 bp, Artificial Sequence
  Synthetic Polynucleotide
ggccgagtataatgttgg

SEQ ID NO: 10762 - DNA, 18 bp, Artificial Sequence
  Synthetic Polynucleotide
ataggggtgtttctctcg

SEQ ID NO: 10763 - DNA, 18 bp, Artificial Sequence
  Synthetic Polynucleotide
gaatccatctgtgaggga

SEQ ID NO: 10764 - DNA, 17 bp, Artificial Sequence
  Synthetic Polynucleotide
ggtaagtgatcccaacg

SEQ ID NO: 10765 - DNA, 18 bp, Artificial Sequence
  Synthetic Polynucleotide
ttcttgttctgtcttcgc

SEQ ID NO: 10766 - DNA, 18 bp, Artificial Sequence
  Synthetic Polynucleotide
cattggtgtgattagtgg

SEQ ID NO: 10767 - DNA, 17 bp, Artificial Sequence
  Synthetic Polynucleotide
agtgcttccgtgtgccg

SEQ ID NO: 10768 - DNA, 17 bp, Artificial Sequence
  Synthetic Polynucleotide
cctggaattgtggctga

SEQ ID NO: 10769 - DNA, 18 bp, Artificial Sequence
  Synthetic Polynucleotide
caaagtgtatccatgtgc

SEQ ID NO: 10770 - DNA, 17 bp, Artificial Sequence
  Synthetic Polynucleotide
tctgccttaagtgatcc

SEQ ID NO: 10771 - DNA, 17 bp, Artificial Sequence
  Synthetic Polynucleotide
acttgattgcgtgtggt

SEQ ID NO: 10772 - DNA, 18 bp, Artificial Sequence
  Synthetic Polynucleotide
gtcaaattttggtgcatg

SEQ ID NO: 10773 - DNA, 18 bp, Artificial Sequence
  Synthetic Polynucleotide
aatccgagctgtgttaaa

SEQ ID NO: 10774 - DNA, 17 bp, Artificial Sequence
  Synthetic Polynucleotide
gctgttattgcctttga

SEQ ID NO: 10775 - DNA, 17 bp, Artificial Sequence
  Synthetic Polynucleotide
ggggctttgtatagtgg

SEQ ID NO: 10776 - DNA, 18 bp, Artificial Sequence
  Synthetic Polynucleotide
tcgtggtgtagtaatctt

SEQ ID NO: 10777 - DNA, 17 bp, Artificial Sequence
  Synthetic Polynucleotide
agctttctcccgactca

SEQ ID NO: 10778 - DNA, 18 bp, Artificial Sequence
  Synthetic Polynucleotide
agtcttttgcatccgact

SEQ ID NO: 10779 - DNA, 18 bp, Artificial Sequence
  Synthetic Polynucleotide
ggagatcattgtgttgtc

SEQ ID NO: 10780 - DNA, 17 bp, Artificial Sequence
  Synthetic Polynucleotide
tgtgttcgttcatgaca

SEQ ID NO: 10781 - DNA, 17 bp, Artificial Sequence
  Synthetic Polynucleotide
tcatcctactgtttgca

SEQ ID NO: 10782 - DNA, 17 bp, Artificial Sequence
  Synthetic Polynucleotide
ttgtgtgctgtgtgctg

SEQ ID NO: 10783 - DNA, 18 bp, Artificial Sequence
  Synthetic Polynucleotide
cctgtgcgtgtcctggcg

SEQ ID NO: 10784 - DNA, 18 bp, Artificial Sequence
  Synthetic Polynucleotide
tgtcccatctgtgtttgt

SEQ ID NO: 10785 - DNA, 17 bp, Artificial Sequence
  Synthetic Polynucleotide
gagtgttacgtgtgcaa

SEQ ID NO: 10786 - DNA, 18 bp, Artificial Sequence
  Synthetic Polynucleotide
gctgcgttctttgaactt

SEQ ID NO: 10787 - DNA, 18 bp, Artificial Sequence
  Synthetic Polynucleotide
tatcttgttttctgggtt

SEQ ID NO: 10788 - DNA, 18 bp, Artificial Sequence
  Synthetic Polynucleotide
gcgttttagtgattacgg

SEQ ID NO: 10789 - DNA, 18 bp, Artificial Sequence
  Synthetic Polynucleotide
tttagctttctcttggct

SEQ ID NO: 10790 - DNA, 18 bp, Artificial Sequence
  Synthetic Polynucleotide
gatggattcaccaaagga

SEQ ID NO: 10791 - DNA, 18 bp, Artificial Sequence
  Synthetic Polynucleotide
gcttctcctcctatttgt

SEQ ID NO: 10792 - DNA, 18 bp, Artificial Sequence
  Synthetic Polynucleotide
tacatcgggtacaagttc

SEQ ID NO: 10793 - DNA, 17 bp, Artificial Sequence
  Synthetic Polynucleotide
gcgcatgttgaagggga

SEQ ID NO: 10794 - DNA, 17 bp, Artificial Sequence
  Synthetic Polynucleotide
aaacgaggattgatgcc

SEQ ID NO: 10795 - DNA, 18 bp, Artificial Sequence
  Synthetic Polynucleotide
acacgcaaaatcacaatg

SEQ ID NO: 10796 - DNA, 18 bp, Artificial Sequence
  Synthetic Polynucleotide
tccattcttcatctccat

SEQ ID NO: 10797 - DNA, 17 bp, Artificial Sequence
  Synthetic Polynucleotide
ttcggtagacaaccttc

SEQ ID NO: 10798 - DNA, 18 bp, Artificial Sequence
  Synthetic Polynucleotide
tacaactcatgtccatgt

SEQ ID NO: 10799 - DNA, 17 bp, Artificial Sequence
  Synthetic Polynucleotide
tcgggatcgcttaacaa

SEQ ID NO: 10800 - DNA, 17 bp, Artificial Sequence
  Synthetic Polynucleotide
caatgttcagaggcaag

SEQ ID NO: 10801 - DNA, 18 bp, Artificial Sequence
  Synthetic Polynucleotide
aatattgacgcaaatgct

SEQ ID NO: 10802 - DNA, 17 bp, Artificial Sequence
  Synthetic Polynucleotide
aacgggttcgctagaca

SEQ ID NO: 10803 - DNA, 17 bp, Artificial Sequence
  Synthetic Polynucleotide
gatacgtttatgtccgc

SEQ ID NO: 10804 - DNA, 18 bp, Artificial Sequence
  Synthetic Polynucleotide
caggtggtttattgttgc

SEQ ID NO: 10805 - DNA, 18 bp, Artificial Sequence
  Synthetic Polynucleotide
cacaaacacagccttttg

SEQ ID NO: 10806 - DNA, 17 bp, Artificial Sequence
  Synthetic Polynucleotide
cgataagtgaaagtcgc

SEQ ID NO: 10807 - DNA, 18 bp, Artificial Sequence
  Synthetic Polynucleotide
ctcgggaactgtttcgtt

SEQ ID NO: 10808 - DNA, 18 bp, Artificial Sequence
  Synthetic Polynucleotide
actagtgggatggtcttt

SEQ ID NO: 10809 - DNA, 18 bp, Artificial Sequence
  Synthetic Polynucleotide
tgtggtattagtgcaggt

SEQ ID NO: 10810 - DNA, 18 bp, Artificial Sequence
  Synthetic Polynucleotide
tttccagcaaattgacca

SEQ ID NO: 10811 - DNA, 17 bp, Artificial Sequence
  Synthetic Polynucleotide
ccttctgctagatcaga

SEQ ID NO: 10812 - DNA, 18 bp, Artificial Sequence
  Synthetic Polynucleotide
gtacgatgcgaatgcagc

SEQ ID NO: 10813 - DNA, 18 bp, Artificial Sequence
  Synthetic Polynucleotide
gctgccatgctatccggg

SEQ ID NO: 10814 - DNA, 17 bp, Artificial Sequence
  Synthetic Polynucleotide
gccatgaacatcatcac

SEQ ID NO: 10815 - DNA, 17 bp, Artificial Sequence
  Synthetic Polynucleotide
ttgataacgtcagccag

SEQ ID NO: 10816 - DNA, 17 bp, Artificial Sequence
  Synthetic Polynucleotide
gttccgatcctccgcca

SEQ ID NO: 10817 - DNA, 18 bp, Artificial Sequence
  Synthetic Polynucleotide
gaccgacaaccatttggt

SEQ ID NO: 10818 - DNA, 18 bp, Artificial Sequence
  Synthetic Polynucleotide
gcgatatgattgactgtg

SEQ ID NO: 10819 - DNA, 18 bp, Artificial Sequence
  Synthetic Polynucleotide
tactcgtgaaattgaaca

SEQ ID NO: 10820 - DNA, 17 bp, Artificial Sequence
  Synthetic Polynucleotide
tcctttgccaattcaac

SEQ ID NO: 10821 - DNA, 17 bp, Artificial Sequence
  Synthetic Polynucleotide
atcagtggggattacgc

SEQ ID NO: 10822 - DNA, 18 bp, Artificial Sequence
  Synthetic Polynucleotide
taattttgtctccgccgc

SEQ ID NO: 10823 - DNA, 18 bp, Artificial Sequence
  Synthetic Polynucleotide
aacttcgaattagggagg

SEQ ID NO: 10824 - DNA, 18 bp, Artificial Sequence
  Synthetic Polynucleotide
agaatacttgccaccatt

SEQ ID NO: 10825 - DNA, 17 bp, Artificial Sequence
  Synthetic Polynucleotide
taaactaggaccgagag

SEQ ID NO: 10826 - DNA, 18 bp, Artificial Sequence
  Synthetic Polynucleotide
gctgtaccatcacctccg

SEQ ID NO: 10827 - DNA, 17 bp, Artificial Sequence
  Synthetic Polynucleotide
cgattctgcgactcatg

SEQ ID NO: 10828 - DNA, 17 bp, Artificial Sequence
  Synthetic Polynucleotide
gccacgtcacatctgtc

SEQ ID NO: 10829 - DNA, 18 bp, Artificial Sequence
  Synthetic Polynucleotide
acgctttagaaggaagct

SEQ ID NO: 10830 - DNA, 18 bp, Artificial Sequence
  Synthetic Polynucleotide
tgcccatcataagctatt

SEQ ID NO: 10831 - DNA, 18 bp, Artificial Sequence
  Synthetic Polynucleotide
atcctcgactttagctca

SEQ ID NO: 10832 - DNA, 18 bp, Artificial Sequence
  Synthetic Polynucleotide
acgtttggtcactccgaa

SEQ ID NO: 10833 - DNA, 18 bp, Artificial Sequence
  Synthetic Polynucleotide
acactcaatggacataga

SEQ ID NO: 10834 - DNA, 18 bp, Artificial Sequence
  Synthetic Polynucleotide
ggttccatcaataaggta

SEQ ID NO: 10835 - DNA, 18 bp, Artificial Sequence
  Synthetic Polynucleotide
ctgacacattcctacagg

SEQ ID NO: 10836 - DNA, 18 bp, Artificial Sequence
  Synthetic Polynucleotide
cacatcttcacaaaccaa

SEQ ID NO: 10837 - DNA, 18 bp, Artificial Sequence
  Synthetic Polynucleotide
ccaaagttacgcttttga

SEQ ID NO: 10838 - DNA, 17 bp, Artificial Sequence
  Synthetic Polynucleotide
atgatagatcactgccc

SEQ ID NO: 10839 - DNA, 17 bp, Artificial Sequence
  Synthetic Polynucleotide
ctgccagaaatgccttc

SEQ ID NO: 10840 - DNA, 18 bp, Artificial Sequence
  Synthetic Polynucleotide
attcacacttggactgaa

SEQ ID NO: 10841 - DNA, 18 bp, Artificial Sequence
  Synthetic Polynucleotide
gcaacgattcttacgatg

SEQ ID NO: 10842 - DNA, 17 bp, Artificial Sequence
  Synthetic Polynucleotide
accattcttactgctgg

SEQ ID NO: 10843 - DNA, 17 bp, Artificial Sequence
  Synthetic Polynucleotide
ggatcaacgccaaccgc

SEQ ID NO: 10844 - DNA, 17 bp, Artificial Sequence
  Synthetic Polynucleotide
tagtatctcctcagggg

SEQ ID NO: 10845 - DNA, 17 bp, Artificial Sequence
  Synthetic Polynucleotide
gatgttagaaagtgcgc

SEQ ID NO: 10846 - DNA, 18 bp, Artificial Sequence
  Synthetic Polynucleotide
gacattccagacaccgtc

SEQ ID NO: 10847 - DNA, 18 bp, Artificial Sequence
  Synthetic Polynucleotide
tgagattactcaaaccga

SEQ ID NO: 10848 - DNA, 18 bp, Artificial Sequence
  Synthetic Polynucleotide
cttcagtttatagccgcc

SEQ ID NO: 10849 - DNA, 18 bp, Artificial Sequence
  Synthetic Polynucleotide
tcaattccagatccttta

SEQ ID NO: 10850 - DNA, 17 bp, Artificial Sequence
  Synthetic Polynucleotide
tacgtctcctaactcac

SEQ ID NO: 10851 - DNA, 18 bp, Artificial Sequence
  Synthetic Polynucleotide
agttatccgataggttcg

SEQ ID NO: 10852 - DNA, 17 bp, Artificial Sequence
  Synthetic Polynucleotide
tgatattttgtcccgcg

SEQ ID NO: 10853 - DNA, 18 bp, Artificial Sequence
  Synthetic Polynucleotide
tgagatcagtaaccatgc

SEQ ID NO: 10854 - DNA, 18 bp, Artificial Sequence
  Synthetic Polynucleotide
ctccaccaacactcctcg

SEQ ID NO: 10855 - DNA, 17 bp, Artificial Sequence
  Synthetic Polynucleotide
ttccgacttgtaatgca

SEQ ID NO: 10856 - DNA, 18 bp, Artificial Sequence
  Synthetic Polynucleotide
gtcaaccgtcttatcact

SEQ ID NO: 10857 - DNA, 18 bp, Artificial Sequence
  Synthetic Polynucleotide
gtacaggaccgatacccc

SEQ ID NO: 10858 - DNA, 18 bp, Artificial Sequence
  Synthetic Polynucleotide
tatcattcagaaccgctt

SEQ ID NO: 10859 - DNA, 17 bp, Artificial Sequence
  Synthetic Polynucleotide
agaacgccgacccagtt

SEQ ID NO: 10860 - DNA, 17 bp, Artificial Sequence
  Synthetic Polynucleotide
ggctccaacactcttgg

SEQ ID NO: 10861 - DNA, 17 bp, Artificial Sequence
  Synthetic Polynucleotide
cgcaatgacacttcaaa

SEQ ID NO: 10862 - DNA, 18 bp, Artificial Sequence
  Synthetic Polynucleotide
attggtcataaccaccat

SEQ ID NO: 10863 - DNA, 18 bp, Artificial Sequence
  Synthetic Polynucleotide
gaagttcctgctcaaatg

SEQ ID NO: 10864 - DNA, 17 bp, Artificial Sequence
  Synthetic Polynucleotide
ggaaaatgcaccaccca

SEQ ID NO: 10865 - DNA, 18 bp, Artificial Sequence
  Synthetic Polynucleotide
cggaaataccgccattat

SEQ ID NO: 10866 - DNA, 17 bp, Artificial Sequence
  Synthetic Polynucleotide
attagccaccgcccaag

SEQ ID NO: 10867 - DNA, 17 bp, Artificial Sequence
  Synthetic Polynucleotide
ggtctatgcctcagaat

SEQ ID NO: 10868 - DNA, 17 bp, Artificial Sequence
  Synthetic Polynucleotide
gctcagaactacgacct

SEQ ID NO: 10869 - DNA, 17 bp, Artificial Sequence
  Synthetic Polynucleotide
tagttacacttgcccaa

SEQ ID NO: 10870 - DNA, 18 bp, Artificial Sequence
  Synthetic Polynucleotide
agctcaaacataatgcca

SEQ ID NO: 10871 - DNA, 17 bp, Artificial Sequence
  Synthetic Polynucleotide
ctgttttggatatgcgc

SEQ ID NO: 10872 - DNA, 18 bp, Artificial Sequence
  Synthetic Polynucleotide
cgcctcatcatcatccat

SEQ ID NO: 10873 - DNA, 17 bp, Artificial Sequence
  Synthetic Polynucleotide
atcgaaatgaaatgccc

SEQ ID NO: 10874 - DNA, 18 bp, Artificial Sequence
  Synthetic Polynucleotide
taaaacaccataaagggc

SEQ ID NO: 10875 - DNA, 17 bp, Artificial Sequence
  Synthetic Polynucleotide
ctgactcagtttggacc

SEQ ID NO: 10876 - DNA, 17 bp, Artificial Sequence
  Synthetic Polynucleotide
tccgtcaccagttccgt

SEQ ID NO: 10877 - DNA, 17 bp, Artificial Sequence
  Synthetic Polynucleotide
catactgccacagactc

SEQ ID NO: 10878 - DNA, 17 bp, Artificial Sequence
  Synthetic Polynucleotide
ttgcaattatcagccac

SEQ ID NO: 10879 - DNA, 18 bp, Artificial Sequence
  Synthetic Polynucleotide
aagtgcgatagagattga

SEQ ID NO: 10880 - DNA, 18 bp, Artificial Sequence
  Synthetic Polynucleotide
gagccaccaacttgtatg

SEQ ID NO: 10881 - DNA, 18 bp, Artificial Sequence
  Synthetic Polynucleotide
tactccaactctactcaa

SEQ ID NO: 10882 - DNA, 18 bp, Artificial Sequence
  Synthetic Polynucleotide
atttcaaccgctacaact

SEQ ID NO: 10883 - DNA, 18 bp, Artificial Sequence
  Synthetic Polynucleotide
aacgatgcgaatagattg

SEQ ID NO: 10884 - DNA, 17 bp, Artificial Sequence
  Synthetic Polynucleotide
gcataaggaagctacgt

SEQ ID NO: 10885 - DNA, 18 bp, Artificial Sequence
  Synthetic Polynucleotide
gcgattcaaagaagagac

SEQ ID NO: 10886 - DNA, 18 bp, Artificial Sequence
  Synthetic Polynucleotide
aacaaattgatatgcccc

SEQ ID NO: 10887 - DNA, 17 bp, Artificial Sequence
  Synthetic Polynucleotide
agcctaccgtttcagat

SEQ ID NO: 10888 - DNA, 18 bp, Artificial Sequence
  Synthetic Polynucleotide
tctgattatccataggga

SEQ ID NO: 10889 - DNA, 18 bp, Artificial Sequence
  Synthetic Polynucleotide
tctactactcagaccctc

SEQ ID NO: 10890 - DNA, 18 bp, Artificial Sequence
  Synthetic Polynucleotide
gcttaacgctccatcttt

SEQ ID NO: 10891 - DNA, 18 bp, Artificial Sequence
  Synthetic Polynucleotide
ggaaagactctcaaacca

SEQ ID NO: 10892 - DNA, 17 bp, Artificial Sequence
  Synthetic Polynucleotide
cacaccgccatcaacat

SEQ ID NO: 10893 - DNA, 17 bp, Artificial Sequence
  Synthetic Polynucleotide
tattgctactacctgga

SEQ ID NO: 10894 - DNA, 18 bp, Artificial Sequence
  Synthetic Polynucleotide
ctttgccagttttcatca

SEQ ID NO: 10895 - DNA, 17 bp, Artificial Sequence
  Synthetic Polynucleotide
gttcttgccgattcagc

SEQ ID NO: 10896 - DNA, 17 bp, Artificial Sequence
  Synthetic Polynucleotide
tcttagccaaccatcag

SEQ ID NO: 10897 - DNA, 17 bp, Artificial Sequence
  Synthetic Polynucleotide
ccgacctcaactacaca

SEQ ID NO: 10898 - DNA, 18 bp, Artificial Sequence
  Synthetic Polynucleotide
aatttgccaactctgcta

SEQ ID NO: 10899 - DNA, 17 bp, Artificial Sequence
  Synthetic Polynucleotide
gccgctaaaatgcctcg

SEQ ID NO: 10900 - DNA, 17 bp, Artificial Sequence
  Synthetic Polynucleotide
gtctcctacgacattgg

SEQ ID NO: 10901 - DNA, 18 bp, Artificial Sequence
  Synthetic Polynucleotide
cgtcctcatccagacctc

SEQ ID NO: 10902 - DNA, 17 bp, Artificial Sequence
  Synthetic Polynucleotide
tcagaactcaaatccgt

SEQ ID NO: 10903 - DNA, 18 bp, Artificial Sequence
  Synthetic Polynucleotide
aggaaattacctgccaat

SEQ ID NO: 10904 - DNA, 18 bp, Artificial Sequence
  Synthetic Polynucleotide
tcttcaacttagctgttc

SEQ ID NO: 10905 - DNA, 17 bp, Artificial Sequence
  Synthetic Polynucleotide
gattcatccgacttggt

SEQ ID NO: 10906 - DNA, 17 bp, Artificial Sequence
  Synthetic Polynucleotide
tgtcacctcaactccaa

SEQ ID NO: 10907 - DNA, 18 bp, Artificial Sequence
  Synthetic Polynucleotide
acaccaacagtttgctgg

SEQ ID NO: 10908 - DNA, 18 bp, Artificial Sequence
  Synthetic Polynucleotide
gattaggattgccgaata

SEQ ID NO: 10909 - DNA, 18 bp, Artificial Sequence
  Synthetic Polynucleotide
cgtcaccttgtctaattg

SEQ ID NO: 10910 - DNA, 18 bp, Artificial Sequence
  Synthetic Polynucleotide
tagaaactccgttttcac

SEQ ID NO: 10911 - DNA, 17 bp, Artificial Sequence
  Synthetic Polynucleotide
gaggaagaaagcccatg

SEQ ID NO: 10912 - DNA, 18 bp, Artificial Sequence
  Synthetic Polynucleotide
tcatgtcaactccaccaa

SEQ ID NO: 10913 - DNA, 18 bp, Artificial Sequence
  Synthetic Polynucleotide
gccagactatactcaaca

SEQ ID NO: 10914 - DNA, 17 bp, Artificial Sequence
  Synthetic Polynucleotide
gaagccacatctagacg

SEQ ID NO: 10915 - DNA, 18 bp, Artificial Sequence
  Synthetic Polynucleotide
agaatacctacaacgcca

SEQ ID NO: 10916 - DNA, 18 bp, Artificial Sequence
  Synthetic Polynucleotide
tcccaaagttccagaaat

SEQ ID NO: 10917 - DNA, 17 bp, Artificial Sequence
  Synthetic Polynucleotide
tatcatctcaacagtgc

SEQ ID NO: 10918 - DNA, 17 bp, Artificial Sequence
  Synthetic Polynucleotide
cgtcagaagactcactc

SEQ ID NO: 10919 - DNA, 17 bp, Artificial Sequence
  Synthetic Polynucleotide
tttgcctctgccttgac

SEQ ID NO: 10920 - DNA, 18 bp, Artificial Sequence
  Synthetic Polynucleotide
ccaagccatacattagct

SEQ ID NO: 10921 - DNA, 17 bp, Artificial Sequence
  Synthetic Polynucleotide
aggacccataaccaaca

SEQ ID NO: 10922 - DNA, 17 bp, Artificial Sequence
  Synthetic Polynucleotide
atctcacaaccgtccct

SEQ ID NO: 10923 - DNA, 17 bp, Artificial Sequence
  Synthetic Polynucleotide
ggccagatcagattaga

SEQ ID NO: 10924 - DNA, 18 bp, Artificial Sequence
  Synthetic Polynucleotide
gcctcatccatcattcca

SEQ ID NO: 10925 - DNA, 17 bp, Artificial Sequence
  Synthetic Polynucleotide
tacaacatcagtgggga

SEQ ID NO: 10926 - DNA, 17 bp, Artificial Sequence
  Synthetic Polynucleotide
ccgccacctgccatgaa

SEQ ID NO: 10927 - DNA, 18 bp, Artificial Sequence
  Synthetic Polynucleotide
cgatacatcaactcacca

SEQ ID NO: 10928 - DNA, 17 bp, Artificial Sequence
  Synthetic Polynucleotide
cacgacattggactcac

SEQ ID NO: 10929 - DNA, 18 bp, Artificial Sequence
  Synthetic Polynucleotide
ccgttaaagactccgcca

SEQ ID NO: 10930 - DNA, 18 bp, Artificial Sequence
  Synthetic Polynucleotide
tcttctcaactccaactg

SEQ ID NO: 10931 - DNA, 17 bp, Artificial Sequence
  Synthetic Polynucleotide
aattacacctgctccaa

SEQ ID NO: 10932 - DNA, 18 bp, Artificial Sequence
  Synthetic Polynucleotide
aaatacaccgacactccg

SEQ ID NO: 10933 - DNA, 18 bp, Artificial Sequence
  Synthetic Polynucleotide
ccagattactcatccacg

SEQ ID NO: 10934 - DNA, 18 bp, Artificial Sequence
  Synthetic Polynucleotide
tctcttgacaacatcaac

SEQ ID NO: 10935 - DNA, 17 bp, Artificial Sequence
  Synthetic Polynucleotide
ctgctcaactcagtggt

SEQ ID NO: 10936 - DNA, 17 bp, Artificial Sequence
  Synthetic Polynucleotide
tttctgtcacccagttt

SEQ ID NO: 10937 - DNA, 17 bp, Artificial Sequence
  Synthetic Polynucleotide
cttcacactacacacca

SEQ ID NO: 10938 - DNA, 18 bp, Artificial Sequence
  Synthetic Polynucleotide
tcatctccaactcaatcc

SEQ ID NO: 10939 - DNA, 18 bp, Artificial Sequence
  Synthetic Polynucleotide
ccttttgccattagcctt

SEQ ID NO: 10940 - DNA, 18 bp, Artificial Sequence
  Synthetic Polynucleotide
cttcgatcttcaccatct

SEQ ID NO: 10941 - DNA, 18 bp, Artificial Sequence
  Synthetic Polynucleotide
acaaattaacacatgccc

SEQ ID NO: 10942 - DNA, 17 bp, Artificial Sequence
  Synthetic Polynucleotide
acaaagctccgaacatc

SEQ ID NO: 10943 - DNA, 17 bp, Artificial Sequence
  Synthetic Polynucleotide
cccatctgctactgccg

SEQ ID NO: 10944 - DNA, 18 bp, Artificial Sequence
  Synthetic Polynucleotide
ccaaattaacaacgccaa

SEQ ID NO: 10945 - DNA, 18 bp, Artificial Sequence
  Synthetic Polynucleotide
gatgccatcatctatgcc

SEQ ID NO: 10946 - DNA, 17 bp, Artificial Sequence
  Synthetic Polynucleotide
ctttctcactacccgtc

SEQ ID NO: 10947 - DNA, 17 bp, Artificial Sequence
  Synthetic Polynucleotide
tctctcagatttgcccg

SEQ ID NO: 10948 - DNA, 17 bp, Artificial Sequence
  Synthetic Polynucleotide
aaattacatcacaccgc

SEQ ID NO: 10949 - DNA, 17 bp, Artificial Sequence
  Synthetic Polynucleotide
cgattacccatccagtt

SEQ ID NO: 10950 - DNA, 18 bp, Artificial Sequence
  Synthetic Polynucleotide
ccattagccaccatccat

SEQ ID NO: 10951 - DNA, 17 bp, Artificial Sequence
  Synthetic Polynucleotide
gactgccgaatacctaa

SEQ ID NO: 10952 - DNA, 17 bp, Artificial Sequence
  Synthetic Polynucleotide
tgtctagtggaggtctt

SEQ ID NO: 10953 - DNA, 17 bp, Artificial Sequence
  Synthetic Polynucleotide
ggtaagagaggtcttgc

SEQ ID NO: 10954 - DNA, 17 bp, Artificial Sequence
  Synthetic Polynucleotide
gcgggattatcttgagt

SEQ ID NO: 10955 - DNA, 17 bp, Artificial Sequence
  Synthetic Polynucleotide
acgtgatacatgagcca

SEQ ID NO: 10956 - DNA, 17 bp, Artificial Sequence
  Synthetic Polynucleotide
ctgggtttgcattttgg

SEQ ID NO: 10957 - DNA, 18 bp, Artificial Sequence
  Synthetic Polynucleotide
attatcagaaggagccac

SEQ ID NO: 10958 - DNA, 18 bp, Artificial Sequence
  Synthetic Polynucleotide
ggtcaggtattgggagat

SEQ ID NO: 10959 - DNA, 18 bp, Artificial Sequence
  Synthetic Polynucleotide
aacatgcgataacaacag

SEQ ID NO: 10960 - DNA, 18 bp, Artificial Sequence
  Synthetic Polynucleotide
ggtggtaaggagtactga

SEQ ID NO: 10961 - DNA, 18 bp, Artificial Sequence
  Synthetic Polynucleotide
gacggttggagggaaatt

SEQ ID NO: 10962 - DNA, 17 bp, Artificial Sequence
  Synthetic Polynucleotide
ctgaggagtggtacact

SEQ ID NO: 10963 - DNA, 18 bp, Artificial Sequence
  Synthetic Polynucleotide
gtaatgggagttccagaa

SEQ ID NO: 10964 - DNA, 17 bp, Artificial Sequence
  Synthetic Polynucleotide
ggagcaaagaaagaagc

SEQ ID NO: 10965 - DNA, 17 bp, Artificial Sequence
  Synthetic Polynucleotide
ggttgcggtggtaattg

SEQ ID NO: 10966 - DNA, 18 bp, Artificial Sequence
  Synthetic Polynucleotide
atcttttgtcagaacggc

SEQ ID NO: 10967 - DNA, 17 bp, Artificial Sequence
  Synthetic Polynucleotide
tctgtttaattggggcc

SEQ ID NO: 10968 - DNA, 18 bp, Artificial Sequence
  Synthetic Polynucleotide
aagacataaggaagaggg

SEQ ID NO: 10969 - DNA, 17 bp, Artificial Sequence
  Synthetic Polynucleotide
tctggggtgtaaagaat

SEQ ID NO: 10970 - DNA, 18 bp, Artificial Sequence
  Synthetic Polynucleotide
tgaagaagagtcgtgagg

SEQ ID NO: 10971 - DNA, 18 bp, Artificial Sequence
  Synthetic Polynucleotide
gcatagctagggttaggc

SEQ ID NO: 10972 - DNA, 17 bp, Artificial Sequence
  Synthetic Polynucleotide
atcagctaggtcaggtg

SEQ ID NO: 10973 - DNA, 18 bp, Artificial Sequence
  Synthetic Polynucleotide
ggaggaataggggatatg

SEQ ID NO: 10974 - DNA, 18 bp, Artificial Sequence
  Synthetic Polynucleotide
tggtacatctaatcagcc

SEQ ID NO: 10975 - DNA, 17 bp, Artificial Sequence
  Synthetic Polynucleotide
aaaattgcgggtggtag

SEQ ID NO: 10976 - DNA, 18 bp, Artificial Sequence
  Synthetic Polynucleotide
cagctagtaatttgggta

SEQ ID NO: 10977 - DNA, 17 bp, Artificial Sequence
  Synthetic Polynucleotide
cataggaggagcggacg

SEQ ID NO: 10978 - DNA, 18 bp, Artificial Sequence
  Synthetic Polynucleotide
aaatcaagcagcagcaca

SEQ ID NO: 10979 - DNA, 17 bp, Artificial Sequence
  Synthetic Polynucleotide
tggtgggagtctgttac

SEQ ID NO: 10980 - DNA, 18 bp, Artificial Sequence
  Synthetic Polynucleotide
gaagagaaggtaaggaga

SEQ ID NO: 10981 - DNA, 18 bp, Artificial Sequence
  Synthetic Polynucleotide
agagtagttacggctacg

SEQ ID NO: 10982 - DNA, 18 bp, Artificial Sequence
  Synthetic Polynucleotide
tgagtgagagtgtaggca

SEQ ID NO: 10983 - DNA, 17 bp, Artificial Sequence
  Synthetic Polynucleotide
cttgagaaggagggtca

SEQ ID NO: 10984 - DNA, 18 bp, Artificial Sequence
  Synthetic Polynucleotide
ccttgtagtgggtatctg

SEQ ID NO: 10985 - DNA, 18 bp, Artificial Sequence
  Synthetic Polynucleotide
atggggtatgagttacac

SEQ ID NO: 10986 - DNA, 18 bp, Artificial Sequence
  Synthetic Polynucleotide
aggtacttttggataggc

SEQ ID NO: 10987 - DNA, 17 bp, Artificial Sequence
  Synthetic Polynucleotide
tgtggaagggtgaagga

SEQ ID NO: 10988 - DNA, 17 bp, Artificial Sequence
  Synthetic Polynucleotide
gcaaggtgtagggttgt

SEQ ID NO: 10989 - DNA, 18 bp, Artificial Sequence
  Synthetic Polynucleotide
actgtgggaaggggaagg

SEQ ID NO: 10990 - DNA, 17 bp, Artificial Sequence
  Synthetic Polynucleotide
atgcggtttgcggttaa

SEQ ID NO: 10991 - DNA, 17 bp, Artificial Sequence
  Synthetic Polynucleotide
ccttggggagagagact

SEQ ID NO: 10992 - DNA, 17 bp, Artificial Sequence
  Synthetic Polynucleotide
atttcattggggagctg

SEQ ID NO: 10993 - DNA, 18 bp, Artificial Sequence
  Synthetic Polynucleotide
ggatgattgtcaacagct

SEQ ID NO: 10994 - DNA, 17 bp, Artificial Sequence
  Synthetic Polynucleotide
tcaggttttggtactgg

SEQ ID NO: 10995 - DNA, 18 bp, Artificial Sequence
  Synthetic Polynucleotide
caagtaggacataggaga

SEQ ID NO: 10996 - DNA, 17 bp, Artificial Sequence
  Synthetic Polynucleotide
ccatcctggtaaaggtt

SEQ ID NO: 10997 - DNA, 18 bp, Artificial Sequence
  Synthetic Polynucleotide
ggacataaaggtcaggta

SEQ ID NO: 10998 - DNA, 18 bp, Artificial Sequence
  Synthetic Polynucleotide
caaagagtgatttgaggg

SEQ ID NO: 10999 - DNA, 17 bp, Artificial Sequence
  Synthetic Polynucleotide
ctgcgggaggggagaaa

SEQ ID NO: 11000 - DNA, 18 bp, Artificial Sequence
  Synthetic Polynucleotide
caaggaaggacatttagc

SEQ ID NO: 11001 - DNA, 17 bp, Artificial Sequence
  Synthetic Polynucleotide
ggaagtgtgggaaagaa

SEQ ID NO: 11002 - DNA, 17 bp, Artificial Sequence
  Synthetic Polynucleotide
gctctattttgagccac

SEQ ID NO: 11003 - DNA, 17 bp, Artificial Sequence
  Synthetic Polynucleotide
gcacaagaagaacatga

SEQ ID NO: 11004 - DNA, 18 bp, Artificial Sequence
  Synthetic Polynucleotide
atgggaaggggtattaac

SEQ ID NO: 11005 - DNA, 18 bp, Artificial Sequence
  Synthetic Polynucleotide
aaattgggcaagtcaaat

SEQ ID NO: 11006 - DNA, 18 bp, Artificial Sequence
  Synthetic Polynucleotide
ggtttgcggttaagctag

SEQ ID NO: 11007 - DNA, 18 bp, Artificial Sequence
  Synthetic Polynucleotide
tttgaaagaaaagggtgg

SEQ ID NO: 11008 - DNA, 18 bp, Artificial Sequence
  Synthetic Polynucleotide
ctttgtgggttgtagggt

SEQ ID NO: 11009 - DNA, 18 bp, Artificial Sequence
  Synthetic Polynucleotide
cacaaaggaataggagga

SEQ ID NO: 11010 - DNA, 18 bp, Artificial Sequence
  Synthetic Polynucleotide
tcattgaggtcataaggt

SEQ ID NO: 11011 - DNA, 17 bp, Artificial Sequence
  Synthetic Polynucleotide
cgacatttagtttgggc

SEQ ID NO: 11012 - DNA, 18 bp, Artificial Sequence
  Synthetic Polynucleotide
cggtgaggaagagattgt

SEQ ID NO: 11013 - DNA, 17 bp, Artificial Sequence
  Synthetic Polynucleotide
gctagtaggattgggtg

SEQ ID NO: 11014 - DNA, 17 bp, Artificial Sequence
  Synthetic Polynucleotide
ggtttgtggttaagcct

SEQ ID NO: 11015 - DNA, 17 bp, Artificial Sequence
  Synthetic Polynucleotide
agcagaagaaatggtga

SEQ ID NO: 11016 - DNA, 18 bp, Artificial Sequence
  Synthetic Polynucleotide
gtatctgaggaggttgtc

SEQ ID NO: 11017 - DNA, 18 bp, Artificial Sequence
  Synthetic Polynucleotide
ccggggtattaatatggg

SEQ ID NO: 11018 - DNA, 17 bp, Artificial Sequence
  Synthetic Polynucleotide
ccagagttcaataggcc

SEQ ID NO: 11019 - DNA, 17 bp, Artificial Sequence
  Synthetic Polynucleotide
gtgaaggtgagactgta

SEQ ID NO: 11020 - DNA, 17 bp, Artificial Sequence
  Synthetic Polynucleotide
ttcggggtaagttcata

SEQ ID NO: 11021 - DNA, 18 bp, Artificial Sequence
  Synthetic Polynucleotide
tggtgagtgaaattaggg

SEQ ID NO: 11022 - DNA, 17 bp, Artificial Sequence
  Synthetic Polynucleotide
aattgaagggtaacgct

SEQ ID NO: 11023 - DNA, 18 bp, Artificial Sequence
  Synthetic Polynucleotide
aggggtggaggagggtac

SEQ ID NO: 11024 - DNA, 17 bp, Artificial Sequence
  Synthetic Polynucleotide
ttctgtgttagtggggc

SEQ ID NO: 11025 - DNA, 18 bp, Artificial Sequence
  Synthetic Polynucleotide
atggtattggggaaaggt

SEQ ID NO: 11026 - DNA, 17 bp, Artificial Sequence
  Synthetic Polynucleotide
ccgaagagagaactgag

SEQ ID NO: 11027 - DNA, 17 bp, Artificial Sequence
  Synthetic Polynucleotide
tcagcagaagagacaac

SEQ ID NO: 11028 - DNA, 18 bp, Artificial Sequence
  Synthetic Polynucleotide
agaaggggtactgggcac

SEQ ID NO: 11029 - DNA, 17 bp, Artificial Sequence
  Synthetic Polynucleotide
gggagagagagagagat

SEQ ID NO: 11030 - DNA, 18 bp, Artificial Sequence
  Synthetic Polynucleotide
ttaaaattaggggagggc

SEQ ID NO: 11031 - DNA, 18 bp, Artificial Sequence
  Synthetic Polynucleotide
aggatttatgataggggc

SEQ ID NO: 11032 - DNA, 18 bp, Artificial Sequence
  Synthetic Polynucleotide
gttctagggttgaaagct

SEQ ID NO: 11033 - DNA, 17 bp, Artificial Sequence
  Synthetic Polynucleotide
atggggaatgagtcagg

SEQ ID NO: 11034 - DNA, 18 bp, Artificial Sequence
  Synthetic Polynucleotide
cctggtttgtagtaggtc

SEQ ID NO: 11035 - DNA, 18 bp, Artificial Sequence
  Synthetic Polynucleotide
catgatcggttggtagaa

SEQ ID NO: 11036 - DNA, 17 bp, Artificial Sequence
  Synthetic Polynucleotide
ttatttgagcgggtgtt

SEQ ID NO: 11037 - DNA, 17 bp, Artificial Sequence
  Synthetic Polynucleotide
atctaggagcagcaagg

SEQ ID NO: 11038 - DNA, 18 bp, Artificial Sequence
  Synthetic Polynucleotide
agtgatttgagggaagga

SEQ ID NO: 11039 - DNA, 18 bp, Artificial Sequence
  Synthetic Polynucleotide
gcaaatacttagggcact

SEQ ID NO: 11040 - DNA, 18 bp, Artificial Sequence
  Synthetic Polynucleotide
aggagaaaaggggtgtat

SEQ ID NO: 11041 - DNA, 18 bp, Artificial Sequence
  Synthetic Polynucleotide
cggggttgaaatttgtta

SEQ ID NO: 11042 - DNA, 17 bp, Artificial Sequence
  Synthetic Polynucleotide
gacgagttaggggtggc

SEQ ID NO: 11043 - DNA, 18 bp, Artificial Sequence
  Synthetic Polynucleotide
gcgtaagaaaagggaaat

SEQ ID NO: 11044 - DNA, 17 bp, Artificial Sequence
  Synthetic Polynucleotide
ttggtggagggaggagc

SEQ ID NO: 11045 - DNA, 17 bp, Artificial Sequence
  Synthetic Polynucleotide
ctcggaggaagaacaag

SEQ ID NO: 11046 - DNA, 17 bp, Artificial Sequence
  Synthetic Polynucleotide
ctttcattttgggcacc

SEQ ID NO: 11047 - DNA, 18 bp, Artificial Sequence
  Synthetic Polynucleotide
aagcagaagaggagctac

SEQ ID NO: 11048 - DNA, 18 bp, Artificial Sequence
  Synthetic Polynucleotide
ctcgtttgcggaatggat

SEQ ID NO: 11049 - DNA, 18 bp, Artificial Sequence
  Synthetic Polynucleotide
gtgtagtcagagacatgg

SEQ ID NO: 11050 - DNA, 18 bp, Artificial Sequence
  Synthetic Polynucleotide
cgggaggtggggtgtttc

SEQ ID NO: 11051 - DNA, 17 bp, Artificial Sequence
  Synthetic Polynucleotide
caggtgtggataaagga

SEQ ID NO: 11052 - DNA, 17 bp, Artificial Sequence
  Synthetic Polynucleotide
tagggtaatggtctagg

SEQ ID NO: 11053 - DNA, 18 bp, Artificial Sequence
  Synthetic Polynucleotide
agaggggaattttaggtg

SEQ ID NO: 11054 - DNA, 17 bp, Artificial Sequence
  Synthetic Polynucleotide
caattcgtgttggttcc

SEQ ID NO: 11055 - DNA, 18 bp, Artificial Sequence
  Synthetic Polynucleotide
tgaggggaaagaaaagtc

SEQ ID NO: 11056 - DNA, 17 bp, Artificial Sequence
  Synthetic Polynucleotide
gactgtcgggtatggat

SEQ ID NO: 11057 - DNA, 18 bp, Artificial Sequence
  Synthetic Polynucleotide
tggagaaattcgtgaagg

SEQ ID NO: 11058 - DNA, 18 bp, Artificial Sequence
  Synthetic Polynucleotide
cacttgggagaatgagca

SEQ ID NO: 11059 - DNA, 17 bp, Artificial Sequence
  Synthetic Polynucleotide
ggcataaagtgggaagg

SEQ ID NO: 11060 - DNA, 17 bp, Artificial Sequence
  Synthetic Polynucleotide
ctttgagagcagcacaa

SEQ ID NO: 11061 - DNA, 18 bp, Artificial Sequence
  Synthetic Polynucleotide
tttgtttaggtcaggtgc

SEQ ID NO: 11062 - DNA, 18 bp, Artificial Sequence
  Synthetic Polynucleotide
aacactgggtaatggagg

SEQ ID NO: 11063 - DNA, 17 bp, Artificial Sequence
  Synthetic Polynucleotide
tagtcaggtaaggacac

SEQ ID NO: 11064 - DNA, 17 bp, Artificial Sequence
  Synthetic Polynucleotide
ctaggggaaggagtaca

SEQ ID NO: 11065 - DNA, 17 bp, Artificial Sequence
  Synthetic Polynucleotide
ctaggtcgagcgggaaa

SEQ ID NO: 11066 - DNA, 17 bp, Artificial Sequence
  Synthetic Polynucleotide
gaagaggtaagaggggc

SEQ ID NO: 11067 - DNA, 18 bp, Artificial Sequence
  Synthetic Polynucleotide
tcattttcggtttggtac

SEQ ID NO: 11068 - DNA, 17 bp, Artificial Sequence
  Synthetic Polynucleotide
gggaggtgaagaaacaa

SEQ ID NO: 11069 - DNA, 18 bp, Artificial Sequence
  Synthetic Polynucleotide
gtgtaggttgggaattct

SEQ ID NO: 11070 - DNA, 18 bp, Artificial Sequence
  Synthetic Polynucleotide
acctgatccagtgagatg

SEQ ID NO: 11071 - DNA, 18 bp, Artificial Sequence
  Synthetic Polynucleotide
tgaggcacttcaacatat

SEQ ID NO: 11072 - DNA, 17 bp, Artificial Sequence
  Synthetic Polynucleotide
gtactcgtgatccttgc

SEQ ID NO: 11073 - DNA, 18 bp, Artificial Sequence
  Synthetic Polynucleotide
tatcagtcaccagcgtct

SEQ ID NO: 11074 - DNA, 17 bp, Artificial Sequence
  Synthetic Polynucleotide
ggagtcggttttctgtt

SEQ ID NO: 11075 - DNA, 18 bp, Artificial Sequence
  Synthetic Polynucleotide
cgactttggattgtcttc

SEQ ID NO: 11076 - DNA, 18 bp, Artificial Sequence
  Synthetic Polynucleotide
gaatcgtgggaagaaagg

SEQ ID NO: 11077 - DNA, 18 bp, Artificial Sequence
  Synthetic Polynucleotide
agattcagaccagaacac

SEQ ID NO: 11078 - DNA, 18 bp, Artificial Sequence
  Synthetic Polynucleotide
gcatcctgctcatcatga

SEQ ID NO: 11079 - DNA, 18 bp, Artificial Sequence
  Synthetic Polynucleotide
gatgtggacaagatggcc

SEQ ID NO: 11080 - DNA, 17 bp, Artificial Sequence
  Synthetic Polynucleotide
tcaacagtctcctctgc

SEQ ID NO: 11081 - DNA, 18 bp, Artificial Sequence
  Synthetic Polynucleotide
aactaacacccctccttt

SEQ ID NO: 11082 - DNA, 17 bp, Artificial Sequence
  Synthetic Polynucleotide
acctcatcatacaaggc

SEQ ID NO: 11083 - DNA, 17 bp, Artificial Sequence
  Synthetic Polynucleotide
gagtctaagagatgggc

SEQ ID NO: 11084 - DNA, 18 bp, Artificial Sequence
  Synthetic Polynucleotide
ctttggattccttcgttt

SEQ ID NO: 11085 - DNA, 17 bp, Artificial Sequence
  Synthetic Polynucleotide
gacactctccagctagt

SEQ ID NO: 11086 - DNA, 17 bp, Artificial Sequence
  Synthetic Polynucleotide
cacactctccgtaccag

SEQ ID NO: 11087 - DNA, 17 bp, Artificial Sequence
  Synthetic Polynucleotide
tcgttgtcactcctgcg

SEQ ID NO: 11088 - DNA, 17 bp, Artificial Sequence
  Synthetic Polynucleotide
gcaccaaatctttgctc

SEQ ID NO: 11089 - DNA, 18 bp, Artificial Sequence
  Synthetic Polynucleotide
gagttctttgggaaaggc

SEQ ID NO: 11090 - DNA, 17 bp, Artificial Sequence
  Synthetic Polynucleotide
cctgttaacccttgcat

SEQ ID NO: 11091 - DNA, 18 bp, Artificial Sequence
  Synthetic Polynucleotide
gcagacccagcatattca

SEQ ID NO: 11092 - DNA, 18 bp, Artificial Sequence
  Synthetic Polynucleotide
gattgagtcggttcgttc

SEQ ID NO: 11093 - DNA, 17 bp, Artificial Sequence
  Synthetic Polynucleotide
ggacggcattcctcaat

SEQ ID NO: 11094 - DNA, 17 bp, Artificial Sequence
  Synthetic Polynucleotide
catgggaacctccttta

SEQ ID NO: 11095 - DNA, 17 bp, Artificial Sequence
  Synthetic Polynucleotide
ggattggactttgaccc

SEQ ID NO: 11096 - DNA, 17 bp, Artificial Sequence
  Synthetic Polynucleotide
ccgagagcgtttgcgtc

SEQ ID NO: 11097 - DNA, 17 bp, Artificial Sequence
  Synthetic Polynucleotide
atgtacaccgcaataga

SEQ ID NO: 11098 - DNA, 18 bp, Artificial Sequence
  Synthetic Polynucleotide
tcggaacatttcttgatt

SEQ ID NO: 11099 - DNA, 17 bp, Artificial Sequence
  Synthetic Polynucleotide
tgtcgggattggaagct

SEQ ID NO: 11100 - DNA, 17 bp, Artificial Sequence
  Synthetic Polynucleotide
ggaaccccttcatgaca

SEQ ID NO: 11101 - DNA, 18 bp, Artificial Sequence
  Synthetic Polynucleotide
tcagcacaaaagactaca

SEQ ID NO: 11102 - DNA, 17 bp, Artificial Sequence
  Synthetic Polynucleotide
cagtggaccattctaga

SEQ ID NO: 11103 - DNA, 17 bp, Artificial Sequence
  Synthetic Polynucleotide
aaactaacacccctcct

SEQ ID NO: 11104 - DNA, 18 bp, Artificial Sequence
  Synthetic Polynucleotide
ttgcactctgtagattgt

SEQ ID NO: 11105 - DNA, 17 bp, Artificial Sequence
  Synthetic Polynucleotide
cctgccaacaatttgcc

SEQ ID NO: 11106 - DNA, 18 bp, Artificial Sequence
  Synthetic Polynucleotide
gctcgataatctccaagc

SEQ ID NO: 11107 - DNA, 18 bp, Artificial Sequence
  Synthetic Polynucleotide
tcatggatttcatccggt

SEQ ID NO: 11108 - DNA, 18 bp, Artificial Sequence
  Synthetic Polynucleotide
aaaaccagtcatctgcat

SEQ ID NO: 11109 - DNA, 18 bp, Artificial Sequence
  Synthetic Polynucleotide
tcatttctccaggctttt

SEQ ID NO: 11110 - DNA, 18 bp, Artificial Sequence
  Synthetic Polynucleotide
ttgttgttcaaaccatga

SEQ ID NO: 11111 - DNA, 18 bp, Artificial Sequence
  Synthetic Polynucleotide
aacattctttgcagatga

SEQ ID NO: 11112 - DNA, 17 bp, Artificial Sequence
  Synthetic Polynucleotide
ctggattctgtcccttt

SEQ ID NO: 11113 - DNA, 18 bp, Artificial Sequence
  Synthetic Polynucleotide
aaatgaaagaagacgcta

SEQ ID NO: 11114 - DNA, 18 bp, Artificial Sequence
  Synthetic Polynucleotide
acacgacgctccgcaagt

SEQ ID NO: 11115 - DNA, 18 bp, Artificial Sequence
  Synthetic Polynucleotide
agttgttacacgctggtt

SEQ ID NO: 11116 - DNA, 17 bp, Artificial Sequence
  Synthetic Polynucleotide
ccgttaggatcatgcca

SEQ ID NO: 11117 - DNA, 17 bp, Artificial Sequence
  Synthetic Polynucleotide
tgtgatgatgggaccag

SEQ ID NO: 11118 - DNA, 18 bp, Artificial Sequence
  Synthetic Polynucleotide
tcgacaagtcctgcccaa

SEQ ID NO: 11119 - DNA, 18 bp, Artificial Sequence
  Synthetic Polynucleotide
tacaggatgatagttggg

SEQ ID NO: 11120 - DNA, 18 bp, Artificial Sequence
  Synthetic Polynucleotide
ccgaaagcacctttgctg

SEQ ID NO: 11121 - DNA, 18 bp, Artificial Sequence
  Synthetic Polynucleotide
ccagtacgctgttcatac

SEQ ID NO: 11122 - DNA, 17 bp, Artificial Sequence
  Synthetic Polynucleotide
gttaaaaccaccatcga

SEQ ID NO: 11123 - DNA, 17 bp, Artificial Sequence
  Synthetic Polynucleotide
acccgtatacttccctg

SEQ ID NO: 11124 - DNA, 17 bp, Artificial Sequence
  Synthetic Polynucleotide
tcccgaatagttcacat

SEQ ID NO: 11125 - DNA, 17 bp, Artificial Sequence
  Synthetic Polynucleotide
tgtgcccaagtatttcg

SEQ ID NO: 11126 - DNA, 18 bp, Artificial Sequence
  Synthetic Polynucleotide
ttgcaccatgtagatcat

SEQ ID NO: 11127 - DNA, 18 bp, Artificial Sequence
  Synthetic Polynucleotide
tatgtccgcaattagtta

SEQ ID NO: 11128 - DNA, 18 bp, Artificial Sequence
  Synthetic Polynucleotide
cgcccaagctaagaaact

SEQ ID NO: 11129 - DNA, 18 bp, Artificial Sequence
  Synthetic Polynucleotide
tcgtatctttatccagcc

SEQ ID NO: 11130 - DNA, 18 bp, Artificial Sequence
  Synthetic Polynucleotide
tcatgatgaaaccattcc

SEQ ID NO: 11131 - DNA, 18 bp, Artificial Sequence
  Synthetic Polynucleotide
cgctcgaactgatgaaaa

SEQ ID NO: 11132 - DNA, 17 bp, Artificial Sequence
  Synthetic Polynucleotide
ttttccgaaaagcccag

SEQ ID NO: 11133 - DNA, 17 bp, Artificial Sequence
  Synthetic Polynucleotide
ggttgaaaccctaaagc

SEQ ID NO: 11134 - DNA, 17 bp, Artificial Sequence
  Synthetic Polynucleotide
acacccaaactatccac

SEQ ID NO: 11135 - DNA, 18 bp, Artificial Sequence
  Synthetic Polynucleotide
actaaaaccgcaaatgta

SEQ ID NO: 11136 - DNA, 17 bp, Artificial Sequence
  Synthetic Polynucleotide
ccttccccacaaaactc

SEQ ID NO: 11137 - DNA, 17 bp, Artificial Sequence
  Synthetic Polynucleotide
ggtcaaaccaccctttt

SEQ ID NO: 11138 - DNA, 17 bp, Artificial Sequence
  Synthetic Polynucleotide
tccaaatcaatgtcagc

SEQ ID NO: 11139 - DNA, 18 bp, Artificial Sequence
  Synthetic Polynucleotide
taacagatgaaccatacg

SEQ ID NO: 11140 - DNA, 18 bp, Artificial Sequence
  Synthetic Polynucleotide
atctttccccttccgtac

SEQ ID NO: 11141 - DNA, 18 bp, Artificial Sequence
  Synthetic Polynucleotide
gaaccaataccgtcagga

SEQ ID NO: 11142 - DNA, 18 bp, Artificial Sequence
  Synthetic Polynucleotide
agatagattccctcgtcg

SEQ ID NO: 11143 - DNA, 18 bp, Artificial Sequence
  Synthetic Polynucleotide
acaccccgaatgaagtct

SEQ ID NO: 11144 - DNA, 18 bp, Artificial Sequence
  Synthetic Polynucleotide
ctgcaaagagatgatcga

SEQ ID NO: 11145 - DNA, 18 bp, Artificial Sequence
  Synthetic Polynucleotide
tcgccccaagaagtactg

SEQ ID NO: 11146 - DNA, 17 bp, Artificial Sequence
  Synthetic Polynucleotide
ggaatgagcaaatcgcg

SEQ ID NO: 11147 - DNA, 18 bp, Artificial Sequence
  Synthetic Polynucleotide
tccacgtttcgtaaaata

SEQ ID NO: 11148 - DNA, 17 bp, Artificial Sequence
  Synthetic Polynucleotide
agaaaggaaccaccatg

SEQ ID NO: 11149 - DNA, 17 bp, Artificial Sequence
  Synthetic Polynucleotide
caggtcttcccacccgg

SEQ ID NO: 11150 - DNA, 17 bp, Artificial Sequence
  Synthetic Polynucleotide
caaacttatcgccccac

SEQ ID NO: 11151 - DNA, 18 bp, Artificial Sequence
  Synthetic Polynucleotide
ggcaaatgaagctagaag

SEQ ID NO: 11152 - DNA, 18 bp, Artificial Sequence
  Synthetic Polynucleotide
acagatactaccgcattg

SEQ ID NO: 11153 - DNA, 17 bp, Artificial Sequence
  Synthetic Polynucleotide
gtgccactactaacccc

SEQ ID NO: 11154 - DNA, 17 bp, Artificial Sequence
  Synthetic Polynucleotide
gaatcgccaccgccctc

SEQ ID NO: 11155 - DNA, 17 bp, Artificial Sequence
  Synthetic Polynucleotide
cgaccgtcacaccgacc

SEQ ID NO: 11156 - DNA, 17 bp, Artificial Sequence
  Synthetic Polynucleotide
aacccgcccatttcctc

SEQ ID NO: 11157 - DNA, 17 bp, Artificial Sequence
  Synthetic Polynucleotide
agcccgaacaagatcga

SEQ ID NO: 11158 - DNA, 17 bp, Artificial Sequence
  Synthetic Polynucleotide
cgtcacgcttgctaaag

SEQ ID NO: 11159 - DNA, 18 bp, Artificial Sequence
  Synthetic Polynucleotide
acctgaaaggcgattgtg

SEQ ID NO: 11160 - DNA, 17 bp, Artificial Sequence
  Synthetic Polynucleotide
ccacgtttatcactccc

SEQ ID NO: 11161 - DNA, 18 bp, Artificial Sequence
  Synthetic Polynucleotide
gtcgggaaagtgaagacc

SEQ ID NO: 11162 - DNA, 17 bp, Artificial Sequence
  Synthetic Polynucleotide
acagtgccattcagaat

SEQ ID NO: 11163 - DNA, 18 bp, Artificial Sequence
  Synthetic Polynucleotide
agacaccccgtatggctt

SEQ ID NO: 11164 - DNA, 18 bp, Artificial Sequence
  Synthetic Polynucleotide
taccccttatcccacagc

SEQ ID NO: 11165 - DNA, 18 bp, Artificial Sequence
  Synthetic Polynucleotide
caacatgctgctcaattt

SEQ ID NO: 11166 - DNA, 17 bp, Artificial Sequence
  Synthetic Polynucleotide
ggaccttcggaaccttg

SEQ ID NO: 11167 - DNA, 18 bp, Artificial Sequence
  Synthetic Polynucleotide
tcctagaaggtgatgttt

SEQ ID NO: 11168 - DNA, 18 bp, Artificial Sequence
  Synthetic Polynucleotide
gacctcgtaagagacgac

SEQ ID NO: 11169 - DNA, 17 bp, Artificial Sequence
  Synthetic Polynucleotide
cctggctcaacaacctc

SEQ ID NO: 11170 - DNA, 18 bp, Artificial Sequence
  Synthetic Polynucleotide
catagcctctctcagttc

SEQ ID NO: 11171 - DNA, 18 bp, Artificial Sequence
  Synthetic Polynucleotide
tcactccccgagtaccgc

SEQ ID NO: 11172 - DNA, 17 bp, Artificial Sequence
  Synthetic Polynucleotide
ggttggacgtagaacgc

SEQ ID NO: 11173 - DNA, 17 bp, Artificial Sequence
  Synthetic Polynucleotide
tggctcaacaatctcgc

SEQ ID NO: 11174 - DNA, 17 bp, Artificial Sequence
  Synthetic Polynucleotide
cgctggttgagcccaac

SEQ ID NO: 11175 - DNA, 17 bp, Artificial Sequence
  Synthetic Polynucleotide
ggggagagggtctcttt

SEQ ID NO: 11176 - DNA, 17 bp, Artificial Sequence
  Synthetic Polynucleotide
gtgagctgccaccaatg

SEQ ID NO: 11177 - DNA, 17 bp, Artificial Sequence
  Synthetic Polynucleotide
ggcgaggtgtgggtcac

SEQ ID NO: 11178 - DNA, 18 bp, Artificial Sequence
  Synthetic Polynucleotide
agtgcgtacctatttagg

SEQ ID NO: 11179 - DNA, 18 bp, Artificial Sequence
  Synthetic Polynucleotide
tggatgaacatggaagtg

SEQ ID NO: 11180 - DNA, 17 bp, Artificial Sequence
  Synthetic Polynucleotide
ccctgtcatctgatcgc

SEQ ID NO: 11181 - DNA, 17 bp, Artificial Sequence
  Synthetic Polynucleotide
cgcgagggtttcttgag

SEQ ID NO: 11182 - DNA, 17 bp, Artificial Sequence
  Synthetic Polynucleotide
aaacattctacgagccg

SEQ ID NO: 11183 - DNA, 17 bp, Artificial Sequence
  Synthetic Polynucleotide
tgccagagcattttcgc

SEQ ID NO: 11184 - DNA, 17 bp, Artificial Sequence
  Synthetic Polynucleotide
aggggagtacacggggc

SEQ ID NO: 11185 - DNA, 17 bp, Artificial Sequence
  Synthetic Polynucleotide
cgcgggtgcatatattt

SEQ ID NO: 11186 - DNA, 18 bp, Artificial Sequence
  Synthetic Polynucleotide
gaagcacgttaacacgat

SEQ ID NO: 11187 - DNA, 17 bp, Artificial Sequence
  Synthetic Polynucleotide
ccgtcaggtaaggtagt

SEQ ID NO: 11188 - DNA, 17 bp, Artificial Sequence
  Synthetic Polynucleotide
cgcgagggattcttgtg

SEQ ID NO: 11189 - DNA, 18 bp, Artificial Sequence
  Synthetic Polynucleotide
cgccactgtagggtagtt

SEQ ID NO: 11190 - DNA, 17 bp, Artificial Sequence
  Synthetic Polynucleotide
gtgccgattatggatcg

SEQ ID NO: 11191 - DNA, 18 bp, Artificial Sequence
  Synthetic Polynucleotide
cgtagggatgagtacctt

SEQ ID NO: 11192 - DNA, 18 bp, Artificial Sequence
  Synthetic Polynucleotide
ccacatggatctgtatct

SEQ ID NO: 11193 - DNA, 18 bp, Artificial Sequence
  Synthetic Polynucleotide
tgcctatgtctaggatcg

SEQ ID NO: 11194 - DNA, 18 bp, Artificial Sequence
  Synthetic Polynucleotide
cagtttgaggtagaagcc

SEQ ID NO: 11195 - DNA, 17 bp, Artificial Sequence
  Synthetic Polynucleotide
gggagagggtatccttt

SEQ ID NO: 11196 - DNA, 17 bp, Artificial Sequence
  Synthetic Polynucleotide
tgaatacattctgcggg

SEQ ID NO: 11197 - DNA, 17 bp, Artificial Sequence
  Synthetic Polynucleotide
tcagagctttgcaacgg

SEQ ID NO: 11198 - DNA, 17 bp, Artificial Sequence
  Synthetic Polynucleotide
tctggaggacacatagt

SEQ ID NO: 11199 - DNA, 17 bp, Artificial Sequence
  Synthetic Polynucleotide
tgcatgaagatcgagaa

SEQ ID NO: 11200 - DNA, 18 bp, Artificial Sequence
  Synthetic Polynucleotide
gggtttgtccgtcttgta

SEQ ID NO: 11201 - DNA, 17 bp, Artificial Sequence
  Synthetic Polynucleotide
ttcatctttggaccgat

SEQ ID NO: 11202 - DNA, 18 bp, Artificial Sequence
  Synthetic Polynucleotide
cattctttgctgcgggtt

SEQ ID NO: 11203 - DNA, 17 bp, Artificial Sequence
  Synthetic Polynucleotide
ctgaaagtcattgccgg

SEQ ID NO: 11204 - DNA, 18 bp, Artificial Sequence
  Synthetic Polynucleotide
cgcctgccattcttctaa

SEQ ID NO: 11205 - DNA, 17 bp, Artificial Sequence
  Synthetic Polynucleotide
gcattgattgccattgt

SEQ ID NO: 11206 - DNA, 17 bp, Artificial Sequence
  Synthetic Polynucleotide
atatgcagactctccac

SEQ ID NO: 11207 - DNA, 17 bp, Artificial Sequence
  Synthetic Polynucleotide
ggttgcccatcacaggc

SEQ ID NO: 11208 - DNA, 18 bp, Artificial Sequence
  Synthetic Polynucleotide
agagatagcatcattggc

SEQ ID NO: 11209 - DNA, 18 bp, Artificial Sequence
  Synthetic Polynucleotide
cagatttacaacgtgcca

SEQ ID NO: 11210 - DNA, 17 bp, Artificial Sequence
  Synthetic Polynucleotide
tcgaaatgtgttgagtc

SEQ ID NO: 11211 - DNA, 17 bp, Artificial Sequence
  Synthetic Polynucleotide
taccgtgacatacaact

SEQ ID NO: 11212 - DNA, 18 bp, Artificial Sequence
  Synthetic Polynucleotide
gttttcatgccccagaga

SEQ ID NO: 11213 - DNA, 18 bp, Artificial Sequence
  Synthetic Polynucleotide
ctccacaatcccgctact

SEQ ID NO: 11214 - DNA, 17 bp, Artificial Sequence
  Synthetic Polynucleotide
accattgcccattccac

SEQ ID NO: 11215 - DNA, 18 bp, Artificial Sequence
  Synthetic Polynucleotide
tcgtagacagccacatca

SEQ ID NO: 11216 - DNA, 18 bp, Artificial Sequence
  Synthetic Polynucleotide
atccaaatcgactccatc

SEQ ID NO: 11217 - DNA, 18 bp, Artificial Sequence
  Synthetic Polynucleotide
tgaaaagtgatcctgctc

SEQ ID NO: 11218 - DNA, 18 bp, Artificial Sequence
  Synthetic Polynucleotide
tctgccagactttcatcg

SEQ ID NO: 11219 - DNA, 17 bp, Artificial Sequence
  Synthetic Polynucleotide
attgcagaggagccagt

SEQ ID NO: 11220 - DNA, 18 bp, Artificial Sequence
  Synthetic Polynucleotide
gcagcccacccatcgttc

SEQ ID NO: 11221 - DNA, 18 bp, Artificial Sequence
  Synthetic Polynucleotide
cacgacagtagtaagaca

SEQ ID NO: 11222 - DNA, 18 bp, Artificial Sequence
  Synthetic Polynucleotide
ttaccatagcccattgcg

SEQ ID NO: 11223 - DNA, 18 bp, Artificial Sequence
  Synthetic Polynucleotide
aaaccgcaatcttgagca

SEQ ID NO: 11224 - DNA, 17 bp, Artificial Sequence
  Synthetic Polynucleotide
caagtaacgtcccactt

SEQ ID NO: 11225 - DNA, 18 bp, Artificial Sequence
  Synthetic Polynucleotide
gcacaattcttcactcgt

SEQ ID NO: 11226 - DNA, 17 bp, Artificial Sequence
  Synthetic Polynucleotide
gtcagtgccttggaagg

SEQ ID NO: 11227 - DNA, 18 bp, Artificial Sequence
  Synthetic Polynucleotide
tccgattaaacgtaacca

SEQ ID NO: 11228 - DNA, 17 bp, Artificial Sequence
  Synthetic Polynucleotide
agagacagcccgccttc

SEQ ID NO: 11229 - DNA, 17 bp, Artificial Sequence
  Synthetic Polynucleotide
tgcgtgcttatatgtga

SEQ ID NO: 11230 - DNA, 17 bp, Artificial Sequence
  Synthetic Polynucleotide
gtttccgcatcaccgtc

SEQ ID NO: 11231 - DNA, 18 bp, Artificial Sequence
  Synthetic Polynucleotide
gccctccagtttgaacat

SEQ ID NO: 11232 - DNA, 18 bp, Artificial Sequence
  Synthetic Polynucleotide
gtaccgcttgacattgtc

SEQ ID NO: 11233 - DNA, 18 bp, Artificial Sequence
  Synthetic Polynucleotide
cttcgaccagtacagatt

SEQ ID NO: 11234 - DNA, 17 bp, Artificial Sequence
  Synthetic Polynucleotide
aacaacccaattacccc

SEQ ID NO: 11235 - DNA, 17 bp, Artificial Sequence
  Synthetic Polynucleotide
aaactcccagtgttgaa

SEQ ID NO: 11236 - DNA, 18 bp, Artificial Sequence
  Synthetic Polynucleotide
cacaatcatccccattgt

SEQ ID NO: 11237 - DNA, 17 bp, Artificial Sequence
  Synthetic Polynucleotide
gatgccttgaagttcga

SEQ ID NO: 11238 - DNA, 18 bp, Artificial Sequence
  Synthetic Polynucleotide
gacccatccctcgccatc

SEQ ID NO: 11239 - DNA, 17 bp, Artificial Sequence
  Synthetic Polynucleotide
agagattcgatcagcac

SEQ ID NO: 11240 - DNA, 17 bp, Artificial Sequence
  Synthetic Polynucleotide
cctcacccaactcgccc

SEQ ID NO: 11241 - DNA, 17 bp, Artificial Sequence
  Synthetic Polynucleotide
gctggacaatccccagt

SEQ ID NO: 11242 - DNA, 18 bp, Artificial Sequence
  Synthetic Polynucleotide
tcaggtacataccccttt

SEQ ID NO: 11243 - DNA, 17 bp, Artificial Sequence
  Synthetic Polynucleotide
tgctagtctttccccgt

SEQ ID NO: 11244 - DNA, 18 bp, Artificial Sequence
  Synthetic Polynucleotide
gaaaacctcagataaccg

SEQ ID NO: 11245 - DNA, 18 bp, Artificial Sequence
  Synthetic Polynucleotide
ggttgccttcttgtgttc

SEQ ID NO: 11246 - DNA, 17 bp, Artificial Sequence
  Synthetic Polynucleotide
aatcgttccactagtcc

SEQ ID NO: 11247 - DNA, 18 bp, Artificial Sequence
  Synthetic Polynucleotide
aaaaccccgtaaattgta

SEQ ID NO: 11248 - DNA, 17 bp, Artificial Sequence
  Synthetic Polynucleotide
cgcagtcatccccattg

SEQ ID NO: 11249 - DNA, 17 bp, Artificial Sequence
  Synthetic Polynucleotide
tacctatcctgtttcgg

SEQ ID NO: 11250 - DNA, 18 bp, Artificial Sequence
  Synthetic Polynucleotide
gtaaatcgtacccgtgtg

SEQ ID NO: 11251 - DNA, 18 bp, Artificial Sequence
  Synthetic Polynucleotide
gccatctccgctaagaat

SEQ ID NO: 11252 - DNA, 18 bp, Artificial Sequence
  Synthetic Polynucleotide
aatgccttgactaccact

SEQ ID NO: 11253 - DNA, 18 bp, Artificial Sequence
  Synthetic Polynucleotide
aaatactccaacccttgc

SEQ ID NO: 11254 - DNA, 18 bp, Artificial Sequence
  Synthetic Polynucleotide
acaagtgttcgtgattcg

SEQ ID NO: 11255 - DNA, 18 bp, Artificial Sequence
  Synthetic Polynucleotide
cgttgccgtaaccgtcag

SEQ ID NO: 11256 - DNA, 17 bp, Artificial Sequence
  Synthetic Polynucleotide
cggaccaccccaaatct

SEQ ID NO: 11257 - DNA, 17 bp, Artificial Sequence
  Synthetic Polynucleotide
tagcattgtacaccatg

SEQ ID NO: 11258 - DNA, 17 bp, Artificial Sequence
  Synthetic Polynucleotide
ccacctccgtaacctcc

SEQ ID NO: 11259 - DNA, 18 bp, Artificial Sequence
  Synthetic Polynucleotide
gtacagcccctttcaggt

SEQ ID NO: 11260 - DNA, 18 bp, Artificial Sequence
  Synthetic Polynucleotide
ggaattctcccctatgag

SEQ ID NO: 11261 - DNA, 18 bp, Artificial Sequence
  Synthetic Polynucleotide
ttagttcgttcgtagtgg

SEQ ID NO: 11262 - DNA, 18 bp, Artificial Sequence
  Synthetic Polynucleotide
caagccacatcttgtgtt

SEQ ID NO: 11263 - DNA, 18 bp, Artificial Sequence
  Synthetic Polynucleotide
acacaccaaaacccaccc

SEQ ID NO: 11264 - DNA, 18 bp, Artificial Sequence
  Synthetic Polynucleotide
acacaatcatccccattg

SEQ ID NO: 11265 - DNA, 18 bp, Artificial Sequence
  Synthetic Polynucleotide
tgatttctccccgtgatc

SEQ ID NO: 11266 - DNA, 18 bp, Artificial Sequence
  Synthetic Polynucleotide
tcccggtcagtcatactt

SEQ ID NO: 11267 - DNA, 18 bp, Artificial Sequence
  Synthetic Polynucleotide
gtacgtgctgtaatctcc

SEQ ID NO: 11268 - DNA, 17 bp, Artificial Sequence
  Synthetic Polynucleotide
ggcgtcaagtgggcaag

SEQ ID NO: 11269 - DNA, 18 bp, Artificial Sequence
  Synthetic Polynucleotide
ggtgtcagcgttgtcagc

SEQ ID NO: 11270 - DNA, 18 bp, Artificial Sequence
  Synthetic Polynucleotide
ttttcggtgtgatagcaa

SEQ ID NO: 11271 - DNA, 18 bp, Artificial Sequence
  Synthetic Polynucleotide
ctccaacaataaagcaga

SEQ ID NO: 11272 - DNA, 18 bp, Artificial Sequence
  Synthetic Polynucleotide
gttgtaggatgtagctgt

SEQ ID NO: 11273 - DNA, 17 bp, Artificial Sequence
  Synthetic Polynucleotide
ttcctcacgatccacag

SEQ ID NO: 11274 - DNA, 17 bp, Artificial Sequence
  Synthetic Polynucleotide
tcagtccaatcggagtt

SEQ ID NO: 11275 - DNA, 17 bp, Artificial Sequence
  Synthetic Polynucleotide
cccagtccaagccaatg

SEQ ID NO: 11276 - DNA, 18 bp, Artificial Sequence
  Synthetic Polynucleotide
atcaggtaaggaagctgt

SEQ ID NO: 11277 - DNA, 17 bp, Artificial Sequence
  Synthetic Polynucleotide
aactagcaaccttcggc

SEQ ID NO: 11278 - DNA, 18 bp, Artificial Sequence
  Synthetic Polynucleotide
tggcatgaatctagaaga

SEQ ID NO: 11279 - DNA, 17 bp, Artificial Sequence
  Synthetic Polynucleotide
gggatggtacgaccttc

SEQ ID NO: 11280 - DNA, 18 bp, Artificial Sequence
  Synthetic Polynucleotide
acacccaacagtggtctc

SEQ ID NO: 11281 - DNA, 17 bp, Artificial Sequence
  Synthetic Polynucleotide
ggcgtttcttgtacacg

SEQ ID NO: 11282 - DNA, 17 bp, Artificial Sequence
  Synthetic Polynucleotide
tagagtagtcctgcatt

SEQ ID NO: 11283 - DNA, 18 bp, Artificial Sequence
  Synthetic Polynucleotide
agccagacaaagataacc

SEQ ID NO: 11284 - DNA, 18 bp, Artificial Sequence
  Synthetic Polynucleotide
tataagactcctcaccat

SEQ ID NO: 11285 - DNA, 17 bp, Artificial Sequence
  Synthetic Polynucleotide
agggatggttttacgac

SEQ ID NO: 11286 - DNA, 17 bp, Artificial Sequence
  Synthetic Polynucleotide
ccggttttgaaagcctt

SEQ ID NO: 11287 - DNA, 17 bp, Artificial Sequence
  Synthetic Polynucleotide
aatgagacaggcaatgt

SEQ ID NO: 11288 - DNA, 18 bp, Artificial Sequence
  Synthetic Polynucleotide
cctggttcccaatccagt

SEQ ID NO: 11289 - DNA, 18 bp, Artificial Sequence
  Synthetic Polynucleotide
tcctgaaataagaggcac

SEQ ID NO: 11290 - DNA, 17 bp, Artificial Sequence
  Synthetic Polynucleotide
gctcgtttcgatattgg

SEQ ID NO: 11291 - DNA, 17 bp, Artificial Sequence
  Synthetic Polynucleotide
caagcggttttctccct

SEQ ID NO: 11292 - DNA, 17 bp, Artificial Sequence
  Synthetic Polynucleotide
atcaactttcgtcgcac

SEQ ID NO: 11293 - DNA, 17 bp, Artificial Sequence
  Synthetic Polynucleotide
ccacataaacagtgtgc

SEQ ID NO: 11294 - DNA, 17 bp, Artificial Sequence
  Synthetic Polynucleotide
ggaccctaagtacaggt

SEQ ID NO: 11295 - DNA, 18 bp, Artificial Sequence
  Synthetic Polynucleotide
taacgtcggaatgtcatt

SEQ ID NO: 11296 - DNA, 18 bp, Artificial Sequence
  Synthetic Polynucleotide
aatccataacggtaggtg

SEQ ID NO: 11297 - DNA, 17 bp, Artificial Sequence
  Synthetic Polynucleotide
ttgatagaacaggcgga

SEQ ID NO: 11298 - DNA, 17 bp, Artificial Sequence
  Synthetic Polynucleotide
acccagaagtacggagc

SEQ ID NO: 11299 - DNA, 18 bp, Artificial Sequence
  Synthetic Polynucleotide
tgttttcactagcagtca

SEQ ID NO: 11300 - DNA, 18 bp, Artificial Sequence
  Synthetic Polynucleotide
taagtcataaaaggtggg

SEQ ID NO: 11301 - DNA, 18 bp, Artificial Sequence
  Synthetic Polynucleotide
cgacttcacaaacacaac

SEQ ID NO: 11302 - DNA, 18 bp, Artificial Sequence
  Synthetic Polynucleotide
agttgtcatagtccagca

SEQ ID NO: 11303 - DNA, 18 bp, Artificial Sequence
  Synthetic Polynucleotide
ccccaagcgtcaagctcg

SEQ ID NO: 11304 - DNA, 18 bp, Artificial Sequence
  Synthetic Polynucleotide
gggcgtcagtaagtaagt

SEQ ID NO: 11305 - DNA, 17 bp, Artificial Sequence
  Synthetic Polynucleotide
tcacatagatgagtcgg

SEQ ID NO: 11306 - DNA, 18 bp, Artificial Sequence
  Synthetic Polynucleotide
ccgatcaacaatctcccc

SEQ ID NO: 11307 - DNA, 17 bp, Artificial Sequence
  Synthetic Polynucleotide
gcggagcataatgaatc

SEQ ID NO: 11308 - DNA, 18 bp, Artificial Sequence
  Synthetic Polynucleotide
agatttctcagtgtcagg

SEQ ID NO: 11309 - DNA, 18 bp, Artificial Sequence
  Synthetic Polynucleotide
actctcttgtatcctcgc

SEQ ID NO: 11310 - DNA, 17 bp, Artificial Sequence
  Synthetic Polynucleotide
gaactcggtggttacgc

SEQ ID NO: 11311 - DNA, 17 bp, Artificial Sequence
  Synthetic Polynucleotide
gctaagggcatctcgac

SEQ ID NO: 11312 - DNA, 18 bp, Artificial Sequence
  Synthetic Polynucleotide
acgccgccagagaatcga

SEQ ID NO: 11313 - DNA, 17 bp, Artificial Sequence
  Synthetic Polynucleotide
cctgcacgatcagctct

SEQ ID NO: 11314 - DNA, 17 bp, Artificial Sequence
  Synthetic Polynucleotide
aggttcagcaagggctt

SEQ ID NO: 11315 - DNA, 17 bp, Artificial Sequence
  Synthetic Polynucleotide
ctctgcccgcattcccg

SEQ ID NO: 11316 - DNA, 17 bp, Artificial Sequence
  Synthetic Polynucleotide
ctgaagcaattcaccct

SEQ ID NO: 11317 - DNA, 17 bp, Artificial Sequence
  Synthetic Polynucleotide
acctacgacgacaacac

SEQ ID NO: 11318 - DNA, 17 bp, Artificial Sequence
  Synthetic Polynucleotide
aagaccatgtccaatcg

SEQ ID NO: 11319 - DNA, 17 bp, Artificial Sequence
  Synthetic Polynucleotide
ggcacctatgacgacaa

SEQ ID NO: 11320 - DNA, 18 bp, Artificial Sequence
  Synthetic Polynucleotide
gctttccaggagccgaaa

SEQ ID NO: 11321 - DNA, 18 bp, Artificial Sequence
  Synthetic Polynucleotide
gctctcttccaagaccca

SEQ ID NO: 11322 - DNA, 17 bp, Artificial Sequence
  Synthetic Polynucleotide
ttccagttgccaaagat

SEQ ID NO: 11323 - DNA, 17 bp, Artificial Sequence
  Synthetic Polynucleotide
tcctttccgccatcgac

SEQ ID NO: 11324 - DNA, 18 bp, Artificial Sequence
  Synthetic Polynucleotide
ttagacggtagttgagga

SEQ ID NO: 11325 - DNA, 17 bp, Artificial Sequence
  Synthetic Polynucleotide
tcaccccatccacaaaa

SEQ ID NO: 11326 - DNA, 18 bp, Artificial Sequence
  Synthetic Polynucleotide
gcgagaagtacatgaggg

SEQ ID NO: 11327 - DNA, 17 bp, Artificial Sequence
  Synthetic Polynucleotide
ccccacccaatccacaa

SEQ ID NO: 11328 - DNA, 18 bp, Artificial Sequence
  Synthetic Polynucleotide
gaagttcgaggacgacgg

SEQ ID NO: 11329 - DNA, 17 bp, Artificial Sequence
  Synthetic Polynucleotide
gccaagtcccaacacaa

SEQ ID NO: 11330 - DNA, 17 bp, Artificial Sequence
  Synthetic Polynucleotide
ccccaagattccagctt

SEQ ID NO: 11331 - DNA, 18 bp, Artificial Sequence
  Synthetic Polynucleotide
gaaatcgttttcatgcac

SEQ ID NO: 11332 - DNA, 18 bp, Artificial Sequence
  Synthetic Polynucleotide
cttctactgagaaggagg

SEQ ID NO: 11333 - DNA, 18 bp, Artificial Sequence
  Synthetic Polynucleotide
ttccaacaatctcacact

SEQ ID NO: 11334 - DNA, 5 bp, Artificial Sequence
  Synthetic Polynucleotide
aaaaa

SEQ ID NO: 11335 - DNA, 21 bp, Artificial Sequence
  Synthetic Polynucleotide
acaggagcagatgatacagta

SEQ ID NO: 11336 - DNA, 20 bp, Artificial Sequence
  Synthetic Polynucleotide
tatggaaaacagatggcagg

SEQ ID NO: 11337 - DNA, 18 bp, Artificial Sequence
  Synthetic Polynucleotide
ctatggcaggaagaagcg

SEQ ID NO: 11338 - DNA, 16 bp, Artificial Sequence
  Synthetic Polynucleotide
tagcagtggcgcccga

SEQ ID NO: 11339 - DNA, 22 bp, Artificial Sequence
  Synthetic Polynucleotide
tctctctccttctagcctccgc

SEQ ID NO: 11340 - DNA, 5 bp, Artificial Sequence
  Synthetic Polynucleotide
aaatg

SEQ ID NO: 11341 - DNA, 5 bp, Artificial Sequence
  Synthetic Polynucleotide
caaga

SEQ ID NO: 11342 - DNA, 5 bp, Artificial Sequence
  Synthetic Polynucleotide
aatcc

SEQ ID NO: 11343 - DNA, 5 bp, Artificial Sequence
  Synthetic Polynucleotide
tcagg

SEQ ID NO: 11344 - DNA, 5 bp, Artificial Sequence
  Synthetic Polynucleotide
agacc

SEQ ID NO: 11345 - DNA, 5 bp, Artificial Sequence
  Synthetic Polynucleotide
cactt

SEQ ID NO: 11346 - DNA, 6 bp, Artificial Sequence
  Synthetic Polynucleotide
tccatg

SEQ ID NO: 11347 - DNA, 6 bp, Artificial Sequence
  Synthetic Polynucleotide
ccaaaa

SEQ ID NO: 11348 - DNA, 6 bp, Artificial Sequence
  Synthetic Polynucleotide
catgga

SEQ ID NO: 11349 - DNA, 6 bp, Artificial Sequence
  Synthetic Polynucleotide
caaagc

SEQ ID NO: 11350 - DNA, 6 bp, Artificial Sequence
  Synthetic Polynucleotide
cacttg

SEQ ID NO: 11351 - DNA, 5 bp, Artificial Sequence
  Synthetic Polynucleotide
ttctg

SEQ ID NO: 11352 - DNA, 5 bp, Artificial Sequence
  Synthetic Polynucleotide
tgtgg

SEQ ID NO: 11353 - DNA, 103 bp, Artificial Sequence
  Synthetic polynucleotide
aggatgcccttcaggtaccccgaggtaacatgtgacactcgggatctgagggggactgggacttctttaaaagtgcccggtttaaaaagcttctatgcctgaa

SEQ ID NO: 11354 - DNA, 149 bp, Artificial Sequence
  Synthetic Polynucleotide
ctctcctttgcacgccgtgggaccatacaggagaagttgatctccgtggcaggactcgccgtccactctggacctgacgagtaccggcgtctcttcgagcccttccagggcctctttgagattccaagctacagatcactttacctgcg

SEQ ID NO: 11355 - DNA, 361 bp, Artificial Sequence
  Synthetic Polynucleotide
gtcatcttctccaaacacaaaggggacacaaagatgaccgaggaggacaaagcgctgttccgccgctgcgctgctgactacgcgtcacgattgcacagcgtactgggtacggcaaatgccccactgagcatctacgaggcaatcaaaggcgtcgacggtcttgacgccatggagccagatactgcgcctggtctcccctgggccctccaggggaagcgccgcggcgcactgattgacttcgagaacggcacggtcggacccgaggtcgcggctgccctagagctcatggagaaaagagaatacaaatttgtttgtcagaccttcctgaaggacgagattcgcccgatggagaaagtacgtg

SEQ ID NO: 11356 - DNA, 17 bp, Artificial Sequence
  Synthetic Polynucleotide
aagcttctatgcctgaa

SEQ ID NO: 11357 - DNA, 17 bp, Artificial Sequence
  Synthetic Polynucleotide
agatcactttacctgcg

SEQ ID NO: 11358 - DNA, 18 bp, Artificial Sequence
  Synthetic Polynucleotide
cgatggagaaagtacgtg

What is claimed is:

1. A computer implemented method to identify a set of probe polynucleotides suitable for detecting a set of target microorganisms, the method comprising a processor:

receiving as input the set of target microorganisms;

receiving as input a set of rules to be satisfied by target sequences and related to hybridization of the target sequences to complementary polynucleotides;

identifying a set of target polynucleotides by selecting one or more target polynucleotides, each target polynucleotide comprised in at least one microorganism of the target microorganisms, each target polynucleotide comprising a target sequence satisfying to the set of rules; and identifying the set of probe polynucleotides by reverse complementing one or more of the target sequences of the target polynucleotides of the identified set of target polynucleotides, wherein identifying a set of target polynucleotides is performed by identifying a first target polynucleotide and a second target polynucleotide in at least one microorganism of the set of target microorganisms, wherein the second target polynucleotide comprises a target sequence satisfying to a rule requiring detection of said at least one microorganism performed by the second target polynucleotide in combination with the first target polynucleotide;

identifying one of the first and the second target polynucleotides in one or more additional target microorganisms, with the one or more additional target microorganisms different from the first target microorganism; and identifying one or more additional target polynucleotides in the one or more additional target microorganisms, wherein the one or more additional target polynucleotides comprise one or more additional target sequences satisfying to a rule requiring detection of said one or more additional target microorganisms performed by said one or more additional target polynucleotides in combination with the one of the first target polynucleotide and the second target polynucleotide, wherein the set of probe polynucleotides includes a first pair of probe polynucleotides identified by complementing target sequences of the first target polynucleotide or the second target polynucleotide and a second pair of probe polynucleotides identified by complementing target sequences of the one of the first target polynucleotide and the second target polynucleotide and target sequences of the one or more additional target polynucleotides;

wherein identifying a first target polynucleotide and a second target polynucleotide in at least one microorganism of the set of target microorganisms is performed by i) identifying a first set of candidate polynucleotides present in at least one of the target microorganisms;

ii) sorting the candidate polynucleotides of the first set by number of target microorganisms in which they occur;

iii) identifying second and third sets of candidate polynucleotides, said second and third sets comprising polynucleotides lying within a distance range of the polynucleotides of the first set of candidate polynucleotides, the second set comprising polynucleotides lying upstream of the first set, and the third set comprising polynucleotides lying downstream of the first set;

iv) sorting the candidate polynucleotides of the second and third sets by number of target microorganisms in which they occur;

v) selecting a most frequently occurring polynucleotide from the first set as the first target polynucleotide and a most frequently occurring polynucleotide from the second or third sets as the second target polynucleotide.

2. The method of claim 1, wherein the probe polynucleotides are primers, whereby a set of primers is being identified, the set of target polynucleotides comprises two or more target polynucleotides.

3. A computer implemented method to identify a set of probe polynucleotides suitable for detecting a set of target microorganisms, the method comprising a processor:

receiving as input the set of target microorganisms;

receiving as input a set of rules to be satisfied by target sequences and related to hybridization of the target sequences to complementary polynucleotides;

identifying a set of target polynucleotides by selecting one or more target polynucleotides, each target polynucleotide comprised in at least one microorganism of the target microorganisms, each target polynucleotide comprising a target sequence satisfying to the set of rules; and identifying the set of probe polynucleotides by reverse complementing one or more of the target sequences of the target polynucleotides of the identified set of target polynucleotides, wherein identifying a set of target polynucleotides is performed by identifying a first target polynucleotide and a second target polynucleotide in at least one microorganism of the set of target microorganisms, wherein the second target polynucleotide comprises a target sequence satisfying to a rule requiring detection of said at least one microorganism performed by the second target polynucleotide in combination with the first target polynucleotide;

identifying one of the first and the second target polynucleotides in one or more additional target microorganisms, with the one or more additional target microorganisms different from the first target microorganism; and identifying one or more additional target polynucleotides in the one or more additional target microorganisms, wherein the one or more additional target polynucleotides comprise one or more additional target sequences satisfying to a rule requiring detection of said one or more additional target microorganisms performed by said one or more additional target polynucleotides in combination with the one of the first target polynucleotide and the second target polynucleotide, wherein the set of probe polynucleotides includes a first pair of probe polynucleotides identified by complementing target sequences of the first target polynucleotide or the second target polynucleotide and a second pair of probe polynucleotides identified by complementing target sequences of the one of the first target polynucleotide and the second target polynucleotide and target sequences of the one or more additional target polynucleotides; and wherein identifying a first target polynucleotide and a second target polynucleotide in at least one microorganism of the set of target microorganisms is performed by
i) identifying a first set of candidate polynucleotides present in at least one of the target microorganisms;
ii) sorting the candidate polynucleotides of the first set by number of target microorganisms in which they occur;
iii) selecting a most frequently occurring polynucleotide as the first target polynucleotide;
iii) for all target microorganisms containing the first target polynucleotide, identifying a second set of candidate polynucleotides within an upstream or downstream distance range of the first target polynucleotide;
iv) sorting the candidate polynucleotides of the second set by number of target microorganisms in which they occur;
v) selecting a most frequently occurring polynucleotide from the sorted candidate polynucleotides of the second set as the second target polynucleotide.

4. A computer implemented method to identify a set of probe polynucleotides suitable for detecting a set of target microorganisms, the method comprising a processor:

receiving as input the set of target microorganisms;

receiving as input a set of rules to be satisfied by target sequences and related to hybridization of the target sequences to complementary polynucleotides;

identifying a set of target polynucleotides by selecting one or more target polynucleotides, each target polynucleotide comprised in at least one microorganism of the target microorganisms, each target polynucleotide comprising a target sequence satisfying to the set of rules; and identifying the set of probe polynucleotides by reverse complementing one or more of the target sequences of the target polynucleotides of the identified set of target polynucleotides, wherein identifying a set of target polynucleotides is performed by identifying a first target polynucleotide and a second target polynucleotide in at least one microorganism of the set of target microorganisms, wherein the second target polynucleotide comprises a target sequence satisfying to a rule requiring detection of said at least one microorganism performed by the second target polynucleotide in combination with the first target polynucleotide;

identifying one of the first and the second target polynucleotides in one or more additional target microorganisms, with the one or more additional target microorganisms different from the first target microorganism; and identifying one or more additional target polynucleotides in the one or more additional target microorganisms, wherein the one or more additional target polynucleotides comprise one or more additional target sequences satisfying to a rule requiring detection of said one or more additional target microorganisms performed by said one or more additional target polynucleotides in combination with the one of the first target polynucleotide and the second target polynucleotide, wherein the set of probe polynucleotides includes a first pair of probe polynucleotides identified by complementing target sequences of the first target polynucleotide or the second target polynucleotide and a second pair of probe polynucleotides identified by complementing target sequences of the one of the first target polynucleotide and the second target polynucleotide and target sequences of the one or more additional target polynucleotides; and wherein identifying a first target polynucleotide and a second target polynucleotide in at least one microorganism of the set of target microorganisms is performed by
i) identifying a set of candidate polynucleotides present in at least one of the target microorganisms;
ii) sorting pairs of the candidate polynucleotides of the set by number of target microorganisms in which they occur within a predetermined distance from each other;
iii) selecting the most frequently occurring pair as the first target polynucleotide and the second polynucleotide respectively.

5. A computer implemented method to select a set of probe polynucleotides configured for detecting a set of target microorganisms, the method comprising a processor:

defining features of target polynucleotides according to a set of rules for sequences of the target polynucleotides;

selecting one or more target polynucleotides of the target polynucleotides by:
i) selecting from the target polynucleotides a first set of candidate polynucleotides present in at least one of the target microorganisms;
ii) sorting the candidate polynucleotides of the first set by number of target microorganisms in which they occur;
iii) selecting a second and third sets of candidate polynucleotides, said second and third sets comprising polynucleotides lying in the at least one of the target microorganism within a distance range of a most frequently occurring polynucleotide of the polynucleotides of the first set of candidate polynucleotides, the second set comprising polynucleotides lying upstream of the most frequently occurring polynucleotide of the first set, and the third set comprising polynucleotides lying downstream of the most frequently occurring polynucleotide of the first set;

iv) sorting the candidate polynucleotides of the second and third sets by number of target microorganisms in which they occur; and v) selecting the most frequently occurring polynucleotide from the first set as a first target polynucleotide and a most frequently occurring polynucleotide from the second or third sets as a second target polynucleotide;

reverse complementing one of the first and second target polynucleotides to obtain a set of probe polynucleotides configured to detect at least one microorganism of the target microorganisms.

6. The method of claim 5, wherein the detection is performed for identification, tracking, or monitoring of infectious diseases.

7. The method of claim 5, wherein the target microorganisms are identified or unidentified pathogens.

8. The method of claim 5, wherein the target microorganisms comprise influenza A, HIV1, Ebola, Norwalk virus, avian influenza, SARS coronavirus, Nipah virus, Hendra virus, Australian bat lyssavirus, Crimean Congo hemorrhagic fever, Venezuelan equine encephalitis, West Nile virus, Hanta virus, hepatitis C, Marburg virus, and foot and mouth disease virus.

9. A computer implemented method to select a set of probe polynucleotides configured to selectively amplify a set of target polynucleotide fragments through PCR amplification prior to sequencing, the method comprising a processor:

defining features of probe polynucleotides according to a set of rules for sequences of the probe polynucleotides;

selecting one or more probe polynucleotides of the probe polynucleotides by:

i) selecting from the probe polynucleotides a first set of candidate probe polynucleotides present in at least one of the target polynucleotide fragments;

ii) sorting the candidate probe polynucleotides of the first set by number of target polynucleotide fragments in which they occur;

iii) selecting a second and third set of candidate probe polynucleotides, said second and third sets comprising polynucleotides lying in the at least one of the target fragments within a distance range of a most frequently occurring polynucleotide of the polynucleotides of the first set of candidate probe polynucleotides, the second set comprising polynucleotides lying upstream of the most frequently occurring polynucleotide of the first set, and the third set comprising polynucleotides lying downstream of the most frequently occurring polynucleotide of the first set;

wherein the distance range satisfies a rule requiring amplification of said at least one target polynucleotide fragment performed by the second or the third target probe polynucleotide in combination with the first target probe polynucleotide;

iv) sorting the candidate probe polynucleotides of the second and third sets by number of target polynucleotide fragments in which they occur; and v) selecting the most frequently occurring probe polynucleotide from the first set as a first target probe polynucleotide and a most frequently occurring polynucleotide from the second or third sets as a second target probe polynucleotide;

vi) reverse complementing one of the first and second target probe polynucleotides to obtain a set of probe polynucleotides configured to detect at least one target polynucleotide fragment of the target polynucleotide fragments in a sample;

vii) updating a list of target polynucleotide fragments to be amplified by eliminating from the list target polynucleotide fragments having desired number of valid amplicons generated by any combination of probes in the set of selected probes; and viii) repeating steps ii) through vi) until desired number of detectable amplicons has been generated for all target polynucleotide fragments to be amplified.

10. A computer implemented method to select a set of probe polynucleotides configured for use in an array for hybridizing target polynucleotide fragments, the method comprising a processor:

defining features of target probe polynucleotides according to a set of rules for sequences of the target probe polynucleotides, wherein the set of rules comprises lengths of the target probe polynucleotides and other parameters that determine the target probe polynucleotide's capability to hybridize to a target polynucleotide fragment to form a probe polynucleotide-target polynucleotide complex;

selecting one or more probe polynucleotides of the probe polynucleotides by:

i) selecting from the target probe polynucleotides a first set of candidate polynucleotides present in at least one of the target polynucleotide fragments;

ii) sorting the candidate polynucleotides of the first set by number of target polynucleotide fragments in which they occur;

iii) excluding from the first set of target probe polynucleotides, polynucleotides configured to hybridize other probe polynucleotides of the first set to form probe polynucleotide-probe polynucleotide complexes, or with non-target polynucleotide fragments to form probe polynucleotide-non-target polynucleotide complexes;

iv) selecting the most frequently occurring polynucleotide from the first set as a first target probe polynucleotide;

v) repeating steps ii) through iv) until each target polynucleotide fragment has desired number of probe polynucleotides capable of hybridizing it.

* * * * *

UNITED STATES PATENT AND TRADEMARK OFFICE
CERTIFICATE OF CORRECTION

PATENT NO. : 9,434,997 B2
APPLICATION NO. : 12/196238
DATED : September 6, 2016
INVENTOR(S) : Bill W. Colston, Jr. et al.

Page 1 of 1

It is certified that error appears in the above-identified patent and that said Letters Patent is hereby corrected as shown below:

In the Specification

Under the title "STATEMENT OF GOVERNMENT GRANT", Column 1, Lines 16-20, delete the paragraph "The United States Government has rights in this invention pursuant to Contract No. DE-AC52-07NA27344 between the U.S. Department of Energy and Lawrence Livermore National Security, LLC, for the operation of Lawrence Livermore National Security."

And replace with the paragraph "The United States Government has rights in this invention pursuant to Contract No. DE-AC52-07NA27344 between the United States Department of Energy and Lawrence Livermore National Security, LLC, for the operation of Lawrence Livermore National Laboratory."

Signed and Sealed this
Fourteenth Day of May, 2019

Andrei Iancu
*Director of the United States Patent and Trademark Office*